United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 3

SEQ ID NO: 126 - DNA, 430182 bp, Homo sapiens
ctcactcaagactgaaaggatgtctttctatttagaggtcaccaaattaacatctcagaccaatcaaggtaggtgggagtctgcgtgagtcccacggtacaagcctcagtgcgcggccctgcaacccccaccaccccagagagagccgatgctgcaaaatgaaggggaggcccaggaatttctaggtctcttctgagtgaaatgattctagacgctagctggaaagaccttctacacagaaaggaaggaaaccagtgtttattgagcagctgttcttggcaatgattccactgctttctttcaggtatctgctgagtccttccaagagcctggtaaggaagtcattttctctatcttgcagaagataaaataggggctcatattaaactatttactcaagaatactcaagtaggaaggaggcaggtggccctgggctgagtctcttctgaccaccatggtagccattggttactggcactgtgccagggctcccacacactgtcttatttacacgttactttgagatgtataacgggccttgggtctagtcggatccttattcttgactaagaaaggagattccacaaagacccaaaatacagatagaatcccacgaatcccatggctatgttcacgaagggagaggagcaccaacaaagtcaagtcactcaggtgcctcactccccaaatgcgggacgtttcctacagaaaccaagcctgctgctcagtgacagctttccaggaaatgccaattccagaaccaaggtacctgaatcacagtgggaaagaccaaggtgggaagcaaatgcagcaattaaggccaaaaataatcccaatgggtgagccgccggaccagagtcacctctgagagcacggagacaaacagcaagcttggcactcggcattttgaagacaacaacccacacctgaactgctgaagaatgtggcgatgtgggcacttggttaagcacacactgatcgccagcgtgagcacacaatcctcagcagcacggcggcccagatttgccgcccacagcccaacagtgccatctcaggagccacggcccccttggagaaggacggggatgctcttcagaggggacactgccaaactgtgtccaggttaaggggataaagaaggatcctatggcacacagaaatgataccacctgggtgccatggggatgctgaacccgtggcacagaagggaagggagaggtgacagcaaatgctcacagagctgccatgtggaggaaggtgaactggagtgcctgaagggtgagatactgcagggtgggaacatctggcctattatggacagagtttttatcacaacaaagaattgggaaacaagtgagtaagtgacctgtgtgaggagggaactattcgcccaggatctgaacaacatggcagatgcaatctctcacactcttacctcttctcctttctggattctccgactggagctgatgataattttgtgtcctctctcaaaagtcaccacttcagccacacaattaggtgcacacgaatggttgatatacctgcaagccaccatgtcagaaaactgtattgtaaaacagctagaagcagctttaaaaacttcccatttattgataaagcagtttttgctaattaaatttctatttgcccattgttagaagcacaaatataacatttaaataaaaattctcaactcatttgctctgaatgtttagtcaccgccaggctgccgtgagagcctttcccttggcttcagtgttctctccaccagcactggccccacaagcaaaagcactccccgtcaggttcctcgctgtctcaccttgcgggccctcctgtgagcgtcgcgtcaatcacatggtcgttatccatgcggaacatgtacacaccacggttctgagggaaaagtcagtcagtaagtcatcaatgtcgacctgaaactcccctctgtgttcctatccacaccaggaggactcagtcgaaactgaacggaacggcagcctgatcatccttactgtggatattctattaggcacagatgacatttacatggcacgaatggaaagcatggaatcagtaggttgtgtgtgaagccaggctcattaatttacagttgtctatcaaagtaaactgtaacaccaattgaaagagatacaactgataaaaatacactaatatacagatatggcttttgtttaaagctgaatgcagcatgacagatttcattctgccttccagggtgtctggctggcacggagaaagggagaggatgatggtgctgtgtatacaatctcggggaccagacacctacctgagactcataaagcttctctttcctgttggctacttcgtttcgaatgatagtcccgatgtactcaatgaccatggtgtgtttctcaatgtctcgagcagcatacaggcccagcccctaaaaaaaagtgtgtacatacttccaatttatgtgacaacaagtcttttttctgtttttcatacaaaggtttcaccctcgggtcttattagaagccatacttaagtttcacttgaactcaaatcatttttgaatatgctattttctgaaattttaaaaattggacatttttactacttaaaactatgccatcactagcttattcctacatcttttttagcactaaattcttagagtctatgtataaagtagtactgtggcttggctgtcttatgtattaggctatctaaccttccagatgagatagctgagttcccaccaactaaataagcttattgacttgtggtgtttattttaccccaatactatttcaaaaaagacataataaattcaataacatagaaatcaggctaactataaccaatcactgatactgtaaacagggttcagacttggctctgagtttcccagcagccagggcaaagagcagacacaggaaacgtcactctgctgtaaatatcaggaatgttggaaacaaatgaagctcttggggaaggtaaatttttcactaatacaaaattctgaggctgggaaagaagtttgaacgggctgaaatggaagcagctctcactgcgcagcttgtactcccgtgctggtggcctgccaggtgcactattcaggttggtagcacaacttgtagagaaacatactaacaaaatatgggtctttgccataaatagttgtattttcttgtcccaattttgggtttttgcacttaattctgactagaaggcaactgaatgcaaaagtactagactagatgcaactgaatcagaagtactagactagaatgcaattctagaattgaactgaattctagaatgcagaaatcaactgcattctagtcggaattactaggaggaccatgtgctgccccagctgcatcctcatgaagcacatccgggagcacatggtgggaagggccatgtgagagactttagtatgtgaactgatttatcctctgaacaagcatctttgattatctgttctactccagatacaactcacaagtgaatgaaccagaacacacaaaaagtatgtatggagatcaatagagtgtggtttaagaataaacaagatcagtggaaatgaagagattccaaatgggccaggcgtggtgactcatgcctataatcccaccactttgggaagccaaggcaggcagatcccttgaggtcaggagttcaagaccagcctggccaacatggtgaaaccccgtctctactaaaaatacaaaaattagctgggcatggtggcgtgtgcctgtaattccagctactagggaggctgagccaagagaattgcttgagccccagaggcagaggttgcagtgagctgagatcatgccactgcactccagcctgggcaacagagtgagactccagaggctgaggcatgagaatcgctttaatctgggagccaagatggcaccactgcactccagtctgggtgacagagtgagactccatctcagaaaagagaaatagatccctgcatgtatgaaaatctaacgtacagtagtaactggtattaaaattcagtttatagtcaagatttcgtggggttagaagaaaaaggccaggtgcggtggctcacacctgtaataccagcactttgggaggcagaggtgggcgggtcacaaggtcaggagtttgaggaccagcctggccaatatggtgaaatcccatctctacttaaaaaaaaaaaaaaaattagccgggcatggtagtacacacctgtagtcccagttacttgggaggctgaggcagaagaatcgcttgaacctgggaggcagaggttgcagtgagccgagatcgtgccactgcactccagcctgggtgacagaggaagactctgtctcaaaaaaaaaaaaaaaaaaaattcatgccagccacgggggctcatgcctgtaatcccagcactttgggaggccgaggcaggtgaattgcttgagttcagaagttcaagaccagcctggacaacatggcaaaacctcatctctaaataaatatttttaaaaattagccaagtattgtggcatgcgcctgtagccctggctactcaggaggctgaggtaagaggatcgcttgagcccaggagatcgaagctgcagtgagctgagattgtgccaccgcactccagcctgggcgacacagtgagaccctgtctcaaagaagaagaaagaaaatcagttaaaaatgagtgggttacttctaaatggcccttcaacaactggttatccaatggaagaaagcgaaattgtattttaaaaatgttatgcaagaaaacctctagaatccgtatataatctagggtcttgaccaagactagatgcaacagaaaattatgtatgtttgtttatataaacagtaacttttacaagaaaaaagatgtcacacttgctggtaggcaaaggatattttgtaggggaaaattctgaatagtgtaaactgctaaaaattgaaaaatggacaaaggatatgaatacgcaattcctatgaaagcaaatccaaatggcggacatgaaaagctgcctattcaattaaggtaacatcagtctatatttatcagaccaactaaacaaaaaaatagtaacaccagctacaaatgggaaacaagaaaacagtctcacatgctgcaggaagaagtgtgcagtaagagactttttagaaaactggcaatatctatttaaatgaaaagtacacacgcttttacacagaaacctcacgtttgggaatataccccataggagtgaaactattaattcattgtgatatttgtacaagatatagcaacactgtttgttatgagaaaaattataaatcaaatacacactcatcagtaatgcaatggtttaactgcagttcatcaacactatggaacatcaggtaaccattcaaaagaatgaaatgaagctacgtcagttgatcgagagggacctctgattattacagagaaaaggaagacggagaaaaataaatataacatgattccatttttatatatgtacataaaagtgtatatagttctaagatattagcacagaaaaacaggatacatattagatcatccacgggatccccagggaggtggacagatgggagggtggcaggatgaaataagtaaagagacagaaaccagagctctcaaaaatgcttcaggttaaaggtgacaggttgaacacagttaagatacccactaaaatcacagtaaaagcacactcctcgagaacacgaatgggtataagagtgaatggactatttaaaatgaaaagtaattgacttagcaggggaaagctagaactggaaggagtagaggcaaagcactaattcacccacagaatccgagagaggctcaacagagaggggcaacagcagagaaaacacagatactccactcataatgtaaaaacaaaatatcaaacaagatcaagagcagaaagggctcgtagctaatctctaaaaatagacaagaaagattagcagataaagtagaggaagtctcagaaagaacagagagacaaggaaacaaagaacagaaggggagaaaggatataagacagaaattactctctgacatgcatgagaatcatccaggaggccccacctccagagctggattcagtgaggctgggctggggcccccgaacctgcacatcctaacaagctcccaggtgacactgctgcttctagtctcaggtccacactgtgagatcctgaatctcaggggttttagtgcaaacacagaggaaacagaggggcagaacttgcaaaagaatgaatacaaaacacatttctcagacggaaggtcacgatgctccaggttgaaagggctcatcaagggaggaaagcaatcaacaaaaagacctccactgaggtgtagttctgtgaaatgtccaaatatcaataaagagaagatcctacaaacttctagtgaggagtaaaagggttccaacaaaggaacaagaatctgaatgagtatagacaaaggaacgctgatccagtttatagggtaaagatactttgctggctgctgagagggaactggatgggaggagacagccaggcctgcagtggtacaggcaagtgatatgtggctcaagatagggctggtaaacctaagagtggatctgagagaatttttaggagaaaacagaactcgatgatgctttaggtttaatctggcagtactgaggccaatgtacacaaacggtaacatcactcagcaaggagcttgtaggatggcggggtttaggagctggacaagtttgacaaagtaagagctttgtaattccattctgagacatccaaggagaaaaatgctgaacaggcatttggatatttgggtctgcagctcaggaagtatggactataggtgtaaacttaaatgcttagcctatacacggccttacttgtaagatagtccacagtctaccaaaaaacatgcactgatttcatgaaacggtagcttccaaaagataaggtaacttccaaaattggtgtacctttggaaaatattttcatttgtatttctctcaagtgcttgaaacagctctactgagcactccacaaatccagtgtgtgcaaattacaatgctacctgcctcccaggagctctcaacaagatgcaaagatgtggattccactggtctgctttccctttggggaagccaatcaccaagtcccaagactacatattaaatccctagtgttaccaagggacaggatttgatacgattttgaaaacacgtttctgtccctgcagctatgtgaaatcattttcacatactggacatcaatagcttcagattgctagactccaccctgtctctccacttcctgtacacaaagtatttcttcacctgaatccgagaccgtgccagatacacattggatttccattcagttttcatcttccggtactgcgatgacttggagtgaacaaactgtttactataaggtgcgttcagttctccagtgactgtgctctgaaatgactttgaggtgctggtgctgtttaaggtgtgaggcctgcagacaatggcatatcaacaggaaaaaaatacaaggaaaactgaagatacctctgagtaatgcccaaaaccaggttaattcagattcttactgacagaaacatacatggaaagctgcctagcagagacacacggcgagttctcttatgtagttgggcacatacacagccagacagcagggtttgtaagcagcagacaaatcaagcacaggaaaccactaatacgcctagaaaccctgggctgtactatgtgaagttaaaacaaaataccttaacacaaacctcttgacatgggcactcattttaggttcagaacgggcacaacctgtggggttaacggcaagaggaagttccatgagaggatttcggccgtatcggaaggtataattttcacatgcctcaaccccaggaagctgaaaagaagcaaagcagacacaaagtcaccccatctgatggagactacagacaatctcaagctggtcaaaggatggcccacgacagaaataactcatcagcgttttccccgataataaaatggtcttctagcttatgttaacactattggcctgcaggtagatctacttaaatatgagtatgcaaattcagtttcaaagccaaacttaggtaaaccctgccaaatgctccttgaagaaaaagattagcccatgcaacaaacactggctgaccaatatacacgcttgtgtgatttcagggcctgactgaaacacacaatacccacaaacacagggcatgtaatgattcgcattgagttctttcccctgtattaatgccaacttttatatctctgtctggaattttacaattaaaaacagttaaaaaatcatctatatggtttctttcttgatcgtttctcactcctttcaatttgactctgatgtgatgaggttatcgctctccatgtcctgggagcataaagcataggtgttaactcaagctttactcaaagtcatttacatgttaaaggtcttttctggaatacattgcttgtgaaatttatttctctgtagtcataaaagataagtatcatttaggcagggcgattccaaagaaaacaattaggcacattactcagtggcttttggggtttcctctgcctgtccaaagaaaacacaccaatgatatttttattcttgaaaacaatgccttagaatcatacaattttctaaaactattgtgtagatatggttcagttagactcactgacaaacaggcttgtaatcttttaagcaaagaaatgtcaagagaggacagaaatcagtgctgctgcgatctactgccctctagtgacttcatcctaggaagagggcaggagagtggccataaatacccaagtgtcaggaaatgggcacactgacattctgaggtgggagaaacttcagaaaggcaagggaagaggagagtgtcctcacccatccagcacacccagaagatgtgacaagcctggtgtccttcacccctgcttgcctccagcctggaagagaacctgaagttggttaactacctcaactgggtgaataccaacacggctgagctctcccgattaatcaccaatgccttattcctctaagagaaacgggttaatgcacaggctcagtcactttctgaagagtgccacaaatgttacagcatgtgttcaagtggtcacactgaatcaggaaagcaattccaatctcaaagcctgaccaagacactcactgattccgctatgcgtgccactgcagagacggtcaggccaaacagatcctctccttttaaatacgctgggaaaagctggagcatttcagacttttttctcacacatgccacaggctccaaaatcttatcccagacacctacacagggacaaaaacataatttttataggaaataggatacagtataaaaaacaagagcaaaatgaagaataaccactcacaaggatttactaatttccaaataaatcctgttgggcaataatctaataaatctgtttggtaataatctaatgaacctgtttattaaatggcagcaattttttttaaagacctaaattttggggaaaataatagattaaggacattaaagtgaaaaaacttaatgtaactgaaattcatgcaaacagttcatttactttcatagtggccatataacataccagattttaaaatgattagtctaattggtaatgtctatagctatgttcctttcccctcagatttaaattaaaatgttaaattgatattttctttggaattatctttagagtattttcagactttttttttttaagtgctaaacttaagaaagcagctccacatacttttgtttgtgtactttctacataagcaaaagtgacaatctagacttaaccatggaggtccaaactaagtgtttaatttccatctctaaacttacgtaatatctgatgttcctatacattgtcttatgacaatgtatacagtatgatttagatgtcattcctgccttctagaaactgactttaagaaaaagggggtccctgccaggtacggtggctcacacctgtaatcccagcactttgggtggctgaggcaggtggatcacctgaggtcaggagtttgagcccagcctggccaacatgctgaaaccctaaaatactaaaaatacaaaattaaaaactactaaaaatataaaaattagccgggcatggtagcgcaagcctgtaatcccagctactcgggaggctgaggcaggagaatcacttgaacccaggaggcggaggttgcagggaactgagatcgcgccattgcagtccagcctgtgcaacaaaagagaaactccgtctcaaaaaaaaaaaaaaaaaaaaagaaaaagaaaaagaaaaaggaggtccccaatgcaaatgacaggcaacctttatctacaaatcattctcggatttacctcaccaactcgtatgttcaaagatatattgattatgaaagtgtttagacaactgtatagcaaagagagcaaggtgtgagaacacaaacattggcatttgtaaatgaaaaatacacattataaaatataaaactaacatgagacaaacatggaaaattgacaaaatacattcattagcctgacatcagagtaagtagcactgcacagcatgtgaacggcagacgttacctttaggtgagatgtcacttagaaccaggtcttcatggccttgttccacaatcctgatgacaaacactgggcgcccatccttctcctcaatggagcacaggtagcggcagcgcctattggcatagcgagtgctccagtacagccggctggcttcatagcccacagggaagagtgctttaggagaatggaatgcttgcatctgctgtggaagcagctgaccaattgtgtggaagatgaggctacccacgcgaaaggtatggtcccgttctcctcgttgcacgatgctagcaatctgtcgcacctcatcacgctgaacatagaccctcctgaagactgcaaagtaacttaattcttgctcatgaattccctttggtttgtgcatggggcaaagcatagttttgtccttaaaaaacatgcattgtgctttaatggcgcaagtgaagtgataaatgttggtgcatcgaaatctgtggcatccactagtggcacccgtcttgtgacagaagacacatttcatttgtaggcctctcctcagagctagctccacatttattaaggcaccagcctgagtctcatagacctccgtggaccacagagcgcagttcaagtggacccacagatccaagtcaaggttgagtagccttgctggtccatctgtcaatccatcaccttcttcatgacaaaagcaacatttccgatagtctttgggcacaggatcaggtttaagggaagtgcccaatttctttagaaattcatctatttcatcctcacaaggtggtttaaatgtccccttagggattacaatatgaatgctccacttcttccatttcattcctctccattttttattgagcggcctgcaatcttcaaacccaccatggacagctcttagccgaggcttcagcttgactgtcaccttcagctcatctggcttggcctcgacttgggctgcttcaaaagcaggagggaaggcgatgggtggtgaggcagggggagaagctttctctgggagctgggggagacagtgcacatccaaagtggagatgttgttgctgtactgatgaaatgctttggaaggcgtttctctcataggtgattgtggcaatgaaggaatggattcctgggcaacataaagaaaccatgacaaagaaaaataattcacaagcccggaaagcaattcttgttaagacaagaagctgagcagtatgactgaagaggatgggtgacctgaggggcagagggagagtcagcagtaagtgctgggggctcatgcaccgcagaagctgaccatgctctaaggtgcacagggatagagagcgggtgatggcagctgtgccgcgtcctttcgaggccttttccacaaagccataattctggagaatattctgctcttacactttctgggacaatcccctttctaactatattaaaaccagaaaaagaaaaaacacacacacactcacaatgctgtcagaagagctaatataatttgtacaatggaacagtgttttttgtttaaccaaataagaacgctgcagcatcgtttcttgagagcttatctccactctaaaattcacatctgttaatctcagccttaatcaattggtgtaaatgttacagaaagggaaggagcccctgtcaacaaatgaatcatactaacttttctctgaggcttctcagctctgatccggctgctgaaacagttgagctgaggggaaatctccaatagcttatttactttatggtacagagtatcataaactaataaacaccaacccacaggctgccctcttttcacatgccccaatcctgacaaggtatctgaaaaaagacatgccttataccaaatcaggcagggactgcacaccaacttaaactatctggtgaaaaaaaaaatccttcttgcatttaggctgatgtattttaagatctaaatttatttgtcatctagcctagattttattacaggcatactacaaacaactacctgttaaaaataagtcttcagaatgttcttctgtgaaagacataccagagcaataacctggatggaggaatgactggcagtattactgtacaggaaaagcttccttcaaaacatgattataaacatatcatttgtatcaaccattagttggacacactcaaattacataaaatcaagtaaagcagacctctttcaccatactgtgagcaaagtgttttctcttaaaatgcacaaatagtcttaaattttatctttaaacaggttttcctattggggtaacatcaataaaaatgattttaaaatattaagatatttacggccgggcgcagtggctcacacctgtaatcccagcactttgagaggctgaggtgggcggatcacgaggtcaggagtttgagaccagcctggccaacatggtgaaaccccatctctactaaactacaaaaattagctgggcgtggtggcacgcacctgtaatcccagctactcaggaggctaaggcaggagaattgcttgaattgggaggcagagtctgcagtgagccaagaggtgccaatgcccttcagcctgtgggaccagaatgagactccatctcaaaaaaaaattaaactggtaaaattaaagattttaatattagtgttctgtttactgaacttttaaaacataactctgcccacttctgtcaaataactaagttgaaagagtagcacgactcaaggctccctacaccctctcctcctctgccgggtcagcacctgctttggattccccacacagagctccatgaaggcagggacacatctttattcactcccatatgcccagaacacagaagtcactcgttacacattgttatcagctgagattatcctaatctcaccttgttttctgagtttttcgcttgtgcagttgatgaataaagaataaagcagttattactacagaagacaatgtccttctctaccctcttggtgctttctcgggaatcctgaaaagcaaagagaaatgtgtgggaatctcaacaagtcaaaatttaataaaaacaggatctatacattatttttatgttatattcaaaagtgacagtggttctttatcttaatagtagaaaggaaactatgttccaatatttagcatgtgataatttagctagggaaaaaatacatgtataaaaccaaactatgtggtccacggttcactctatttaaaaatacgtagtcctcataatattccctttaacagcctgttgtagctctttggtgttcagcccaagcacatctgatatacgctggtgccatcaccaggaacatgtgtccatcacaccaccataagtggtgtctctctctgatgttggaagagacactgccaaggacattttcgctggaggtaggaggtggggtcataaaaggagtagcaaagtaccttgttcaaaagggtcagatctttgaaagatttccgcacaccacttccaagaataaccactttacaatgacaacaccactgtggtctgagtgctgcgctttctgcaataccatgactagaatccttatatccagaaagacctaaaggcaatcaacttttgttagtaattaaaactgactgatgacacaaggtggcacatggtgaaaaattatgcagtatcaactcattacaacatggttcattaacattattctttaattaataaaaaaaatttatcttctaagcaatggttacagagtcgattatctgacactagggcaaaaataaagaaacatgcctattctcaaatagctgggaaagcaatggcagtataaaagaagaatctaataaaactaagtcaccaagagagattactattcagtctaagtacaaagtaagacagagagggaaacagatattacttttgcttgcaggttaagatggtaaaaaaacattttatgaaagatacaatgacatatgtataagagtcttaaataagtgtgacttgcagagtcagaaatgaggaaagagccaaggccaaggataagaaggtaaataaggactcaggaattagaaagcatcattcaggtgcagtgtgaaggcaaaaaggagcagggaaaaagtgacagaacagctagaagccaagaggaggaagccagggcctggactgagcacgcctgtaagattgccagtgaggcaggaaggaaagcgacatcatggtcggtctaaggaagttgttccattctcagagatggggggcatgaacacctctgtgggaagagaagggccctatagagctggtgcagaggtaaaacaagaggtaggtgaggatggaaagcagaggagaacaggaaacagaacccacgtcaggtcaccagccccatctgtaccaggtggcccaggtgcagcgggatgggggttgggagacaggaagaacaaaagctgctcaagggcaagcccgtcacaggcttcttctggcagcctgcacagatggctggcactcacatagcccctggtgacagcatgacagaatacacaggccaaagcactagaggtcaaaatcacagcacagaaaacagaacacccacacatggtaagttcaccaaggactatacgccagcatgttacctgtccgttgttaaaagataatcagtatctcaaagagtaagcttaacttttgaatcaggaatggatttggggttaacaaaaagctcactagctcaccattgcttgttggaggaaatggtacattaggctgcttcagccggtaagagctcactaatctgggagggtttgcagatcctggcggaggcccacggagaagtaaatgctgtcgatactccaaacccgggttgattctgtggctactgaccaaacccatggatgggacatctggagcactgctaacctcatagctgttagggattcggacgtgaagaaggtcggaaaatgcagccacaacactgctaatgttctaaaaccaaatgcaaatgctgtattattcacccagaaggcaacagtgaaccactgaagaaaaatacacacttaggataaatcctctttgcatgatacatagattctaagaaaatccaacaaattttatttagacttaaagaacctcaggaaaaaaattagctctaacgaactaatatccaaaaaaagaaatttataaacagaaatcctcataaagggattccaattaacattaaatatctagtaacacattaaactattttagatattgtaacatctgacagaccccgtcagttcctacaggtggtcagaaagcttacttccaggggcttccctccagctctgacacaacccgtaagaacagacaaaggtcttgctactgctgtattttgttgataaccaaaatatcacatcattggacttctagtttggtctctactgaaatgtcttcacagaattcagagttaaaaaaataaaaaatcctcaggaaattacttatgtttgatataagcagatgctacttgaagaacatttctattgcttctgcaaaactattactgttgataaagttctttttcattgcttaattttcttctctgttaacagttacaaagaagttttttctgagatggacatgatggctcacacatgtagtcccagctactgaggaggctaaagcagaaggattacttgagcccagtaagtttgaggctgcagtgagctatgactgtgccactgcactccagcctgggcaacagaaggagactgtgtctctattaaaaaaaaaaaaaaaaaaagagttctctaaagtatacatcctttaataagaaaatgtgagctctaatttccctttttacttgacgtaggctgagaccaattcaatgacaaacgatggcactcaaaggcagctgagaggtctgcagtgagcatcagctctgctctctgaccctttatcctcagtgatcctgtttgtgtgtgttttatggtagacacctgacccatctttgaaaattggggacatactgtttaacattaagaagtcatttaatcttttacctcagcagctgtaggatgcagagtaattgctacagatataagacctgatctgggaccatttggggaaggaccaaaaggtgacgcaaaatataaagtgcctggctcagttttgatgtcattccttcttgattctgaacctttaaaaagagagaaaaaaaagaggaaaatagtgttaatggattttcaaaatcaaaatatttacattagtaaattggcgtagtgtaaagggaaataataaggttaagtgttgttcttacttttcccagcagtgctaggaagaattggaatgatgggggacggcaccggttctggaggctcctccttgaccaatgacagatctggatacctgctcacttctaccccaaccacactctcaggagaggatgagggaacaaaactgtcaggagtatctcgatcaccacagtgatcctgtatcctgaaaaaacataaacacacacatcaaagtctgcaaatccaccactgggggcttcctgtaccaaccctgctgacatctgtgaatacagctgtaaggatactctgggcagcacctatacgatgagcagcaaatgaatcagctcagagccacactgggaaaaaaatacaagaacaatatttagttacaaaataatttaaatggtatgtttccttttaacgaaagcttcagcaccaaagtttgaagacctgccaaagaggaagatgttctgattagcatgtaacatagagagcatgaaagcaccttttcaaaatcccagatcgttgagcctagggcagcactcctgcagcttgaaaaggaaagagctgctggttggatttaacaataaaaaaggaaaactttaaaaagacaaaaaaaaaaggaaagagaagtccaacacatatgcaatggtcacacctgcattcacctgactgggaaaacagctgtcctactgctgctctttacactggcaagatgggagaaaacttagccattgacttgatcggcccttatttttcttaactgataaagtgaggtgagaaaaacaaaagactggtcccttctgttgagttcaagtttgagtctaccaggccaattgtgaggtctcagactaagttccacaaccctgtggaactgctgtctcccactcctcacgcagagaagtagctgtcatgcaggagacccaagaaaggctggcctactgaggtacagtagaaagaggacctggatcctcaattgggacagattattctccacttcggtccaaagtttccccattaataaagtaagggacttaggttaaataaatgtctcatcaaatagagggtagtgggcagattttccaaagaagagataattatttgatgaagttgtaagaaccctctggatctaaagagttggctagcgatcatctactaagggaacttgattctccccaattagaatcttacagttaaagaactgacacaaagacatcaaaccccagacagttcttaaactctcttccacgacggcgttctctgatatagcaacttctgctctttcattttagacatctacaaacaacaataaacccaataaatcacattaataccctttaaaggacaatgatttctgaaatatgttgcatggagattttccactaccttcatgtctattagattatttaattagattaaataatctaatacttaactgtctattagattatttaactctctatatgatgtaggcttaaaaaaatgcaaactaattatgtttaatggtaacaatgtcttataaactttaaatcctgaagattattcaccaaattgtactcttcaaatgtttttacatgctattcctaaagacattatgccacatacatacatttattttttttaaaagaagaaataactaagaattatttgagaaaaaaataacctgtaccttaattcttcctgattgttatgaggtggtgttgggagggaggctggcacatcaactgtcttggggccctgagcaagagctcgggccaacaagtcgtcctggggtctgaagggcagctgaaatggtttaggtcctagagttttggtaactggaaaagcaaaaacacaaaaccataaatacattcagtcaatattgataaatgggtagaactttacaattctattgccatttcacaatacacaactggcagaggcacatttctccgaggtgtgaaatttggaggctataatcataccttcatggctcactaacactccggcttttccagcaagttcttcagttgttgcaaaaccattggccatcttctgacaagccataggaggtggtgtaggaggaagagaggcagggggtgttggaggattacttaaattattctgctgcaggagaccaaaaaatttaaattatatgctactgagcgaatatgcaatgaccttgctaaaacgtagttctgtgaattttttgcacatagaagcaaggctacagaaatgtaatcaagatgtatcttgcacaccaagaaaacaatacctacaaggccaggaggcttcttagtggaacagatactcgtgattttatggacataccaacttgcttactttacccagcttgactacttaagctctgaaattaagaagctaatttcctttctacctgattttatttatgcaattcttcaagtttcgtggttatagctagtgaaggataactttaaaatgcaatcaagaaattgcaaaatattatcaaaatatcctttaagttctcattaagatatgccctagttctatgaaaaacttaagaatttctggtcttaaacttgtaatacaactcacatccgagatatgagaatctggattgactaagacctttaaaagaagcaacagtactaatgctactactaaagtaactaaatcattaatgtagttcctcttcagacacctctcccagcttaacagttatcaccaatttgtcatttactgattagtctctcaaggagagacttggaatctaccaataacaccatgcaaatcaagtgcaaagtcaaattacaaattttgcaaagataaagaatttcatgaggatgataaaataaggttggagaacagcttatgagttaagatagttttttttttttctttttggagacagagacttgctctgtcacccaagctagaggtagagggcaatggcacaatcatgctcactgcagccttgacctcagggtgtggtggtgcatgcctgtagtcccagctacttggtaggttgaggcactagaattgcttgaatttgggaggcagagattgcagggagctgagattgcaccactgcaatctggcctgggtgacagagcgagaccctgtctcaaaaaaaaaaaaaaaacctacaatagtctaggaattacttgtaattaatacctaaattattagatatacttaaaattgtttaatttcatttttcaaggtaaactactactttttttaaatccccaccatttacaatgatttttgaattcattttaagtgttaataaaggttataaggaaataaggatttccactaccatggaagtacataatagatatttcttgcaatttgtattcttacctataaaaacaacttcaaatgtttatgctagaaatacttcaccaggtaaaattttaaccctgtagctgaacttaagttttaataaaacttggaagagtagatgtaaactaaatacaaaaataagacaagctctatcaattctgacatgttacccaaagatgaagcaagacaacaccttggcagagaaacataccttgtagatcaactgagaatagtagtccgaaaccccttccagggtagcactgccaaaagttcctagaagtcgattcccactattaaattggccactgccataaggaagaaagtgcgcaaagttcactccaatgattggttccattagagggagcagagagagctgctattaaaaaacacatttaagagtaatgtacatgataaaaggaactcagtgtagctcaactttctaagacccgaagcaactttgttgaataaggcttcagaaaaatgagacttaaaattttcaagtatcaaaatgctggagtaagtgagagagactacagacctttgagacttaaaaataagctctgtactaaatgaatgctgccaggcatctaacaagaaaaacatatttcttatctatgctcagcaaaaactggggcatcaactgaggctgggtaccaccaacagcactgttagcaactgtctcccaccttctgtaacaaccacaaaggtgtagaacagaattcacaatgtgtttctttggattcagagtcacaacaaagtactgaggacagatttttttcttggtactgaggctactccttatgaacataagaaaatcttgactatcacctatcaatccatttgtattaccgtaaatttcagatgccaataggatacggtgcaattctgcttggaaaaagtctactaggttccttgtccagatgtcttttagcatttgatctctcgtgtccttgaattgtttgttttttttttgtttttttttttgagacacagtctcattctgtcacccaggctggagtgcagtggcacaatctcggctcactgcaacctctgccatccaggctcaagcaattctcgtgcctcagcctcccaagtagctggaattacaggcgtgtaccaccacgcccagtaaatgtttgtatttttcgtagagatgaggttttgccatgttggctaagctcatctagaactcatgcctcaagtgatccacctgcctcagcctcccaaagtgctgggattacaggcatgagccactgcccccagcctatatccttgacttttaaaagaggctgctctaaatgactcaccctcacctgtttcaagtgggtaaacgtgtcagtgctagagtacatagcttgtttctcctcttcgtcctttttccttttctttgagcgaggtgctgctttctcacccgtcctctgagtccgtttgcttcgctgtttcttggtttcacttcctccatctgtttttggcaactggttgccacatccaaaaccaccttgcatttgagcccccaaagtttgctaatgtaattggaaagggtaaaaaataagtgaacaatttgcatatttggtttttagttcatgcagtgccaagctatgacgcgtcatcctaacatggcactaaaaggtattaaataagtagggaagatagagtggtgtcaatgctggttttccaaaaacaccatccttttcttcaaacgttattctcgagtatggaaatcagtaagctgcgaagcttgaggaaagagcagaactcattagtaaggccacagccctttctggcaaagcattacccctcatgctgacctccctggggctggggaaccccttattcctgcttacttactgcagaagggaaggaaatgcttgtagatggctataggagcctctgcatagtggtcttggtgagttatttttggttccccttaggaactagtgaaatatgaggtgtgctgaaacaattcacaggctccagaaaagctttacagcctatgcatcttaggtgagagaacagatagcaccagacaacaataaaaagaaaaaacactggttcttcaaattagttcacaaccgtatttgactgaaaaataatggccacatacttaaagtcaatgggagagaacgtagatgataacaaataaaccttttctttatttttatcattacaaagtgagaataagccaagccctgaaaaggcctttaagggtagtcctatcagtaccttaaaacacaggaatattttcaggctccattatttctaaatttaacagcagtactctgctatagacgattatagtagctgaacttactgtaatgaattctgcattgaatctctgacggttctgaaaattagtttccagttatattctaaatagtttagcgcatggatggcaacatttttatgtaaagagccagatgataaatattgtaagcctctgtaggccatacagcccctggcataattactcaactctgcccttgtacttcaaaagcagccataaacaattcataaatcaatgagcttggctgcgttcaaataaaacttttaaaattcacggacaaatttgaattttgtataatttttatgtgtcacaaaatactactcttccttagattttttttcaaccatttaaaaatgtaaaagccatttttagctcatggagggaggcgaaagcaggcttagactgctcatctccaggctagttctgtggctctcaaggggtctccagggcggcagcagcatctagagctggtctagaaatgcagattatctggtcccacccagacctgcagaatcagaaataccggggctggagcccagcaatcttggtttaacaagccctcctggtgctcctcacactttagctttgagaatcacctgcctagagcagtacttctccccttcagatgctcaggaatcacctggggatcttcctaagtctacattctgagaagcaggtgtgtggcgggagattctgcatgtgttacaaagctcccacctgatgtggatgctgcggatccccaaggactgcactctgagtggcaagaacctaaaaattaattatatatatatatttatatatttatatttatatatatatttatatatagatgtatatatttatatatatttaaatcactatatatttatttaaatcacactttaatttggggggaggggctactttttaaacttgacgtggttgttccccatgccattaaacattcttacacccacaaattttaatataaacatgctcaaaatgtagtctacgtccttcaaggagctatttaaataatgttaagtggtacaacagaaatcgctatgtgagaacacgagcatcaacacatatttgagattgggagaggtgagaaaggtatctggaaaaagatgactcaagaactgcatttcaaaagataaaaatatattgtccagacgtatataagaagggagaacagaacaggcagaagcagcagcatgtggtatacatagaagggtaaaaagacagaaggctgcaagttattcagtactcctcagggtataagatgtcttggagaaagtggatggagactgtgctggagagttgcctatatttactggtgacaactgtaaaagcataaccagtaaaatttacaaaaattacacaaatctatcaagtcaacactcaatctctactgaatggtcaaagacaagaaaaaaagcaacacttgcaaaaagatgagcttcattaacaatcttaaaatgaaaaaactggacaactaaatataccactcaacccttaattaaaatatgaaaatgaaatccaatttgagaagctctctagggacagctttatgaatgcactggtaatggcactgcaccttctgaaagataaacaggcaagagctattaagcagaccaattcccatgactcaaactccagttttggaactatcttaatgaagttaactgaaataaaggggacagattcttgtaaaggtatatttacaagttagctcttcatgtaaatgaaaaaaaaagcaaattaaatgttaataacttaaaactgatagaaaattgatacatggaaaactacaaaacagtatctacatgtaacattacattaagtatcaatacaacactgtaaccacacaatagcttcccagtgtggtatccctaagagtgccaagggtattaataggggtgcatgggctatcctctgcattttaaagaggttaatggaaattaatcacttatttacaataaagtacatagacatttacttactttgctttagtcatatcaactcaatgtggtaataaccagttgctacacatcacgttatatatgaaatgcaatacatgcctttgctttttaaaaaatagtaaacaaattattatttaatatagtttagatataagtaaaaacatgggttccagagaggtagaaatgacaaaataaaaaatggtcctttagaataaaaaggttgtagaataatgtggaaatacagttgctggtactaatctgctgtaagtataatttaaaacaaaagaaaaaagttgtcgtttttatgatttacacttaccagtccttcagctgggttctgcttctcaactagtttattatcctttgtacagtcatcttctgaacaaatactgccctcaggtttttgattcaaaagagaagatgactttttatttttcaacaagtgtttcagaagttcattccctgagtctcctttggcagcaggggccccagcagaatggggaggactctgtgctgaggagacaggacaggctacagcgtttccttctaccttactaccattctgttcctccaatttaggctcctcttggcctgggcaggactctgtctcagccttttccagttttatctcttctgttttggcaggggtttccatggagagcttgtctacttctgaatttgcatacgtctgttgatttggagttgcttgtgagaaatcactattgggcagtttgttctctaattctgtacatagctggcctgctgccatattgggagtggatgggccgactggttccaccgactcttggtcggcttgttgaggaagctcactgggtgtgctcactgcaggagtagaggtagtttctgagatgcctggagtcggtggggcagttatatctgaatggggagttgatggagccttggtggattctgcatcatcatctcttttcttctttcttgttcttttctttttccctttttcctctgggattatatcagaatacaactgaatgagcgattgggttgatcccggataactgtgtccatgggttatagtagaatcttggccacatgggagactgctattagctactggaggtgctgctggtaaagcaggtgtaaaagaaggcctcactggggactgctggaagctggtcccagaaagatttccatgtccctgcttcacagaagaaaaatttgggcttccaacagggattgatggtgaatcaggaacaaatgaaggagggcctacctgccttcgctcattagtctgcatgaaagtttgggtggagggtgaattaattgatccttgttgtatattctgctgctgtaaaacctgccccatttgctgttggtgttgtggagactgctgaaggggtcctagaggttgcataaaatcacaaggtaagtcggaactgtagaagggaatctgggacacagatgtcctactactacttatctcagagcccaccataccatgctgctccatttccatcctctgctgcaaagctctttgtctatctacctcctgcatgagttggatccgttgtctctcttgctgttctcgtaaacgttccttacgttcccgttcttgaaaactttcactaaagggattgttgtcatcaaattctacccgaggtggtggtccactctgtggatttgcatttgagactgtccctggggctggtgtacaagtttttattggtaactgggcaattgggggctgaattctaggaggattgaggggcaggtgggcaggagcactgttgggttgccatccaggtaaactgggcattctaacagggctagtatggccagaaataactgttgtgtgctgctggtgctgaagctgctgtggcaccatgggaaaggtgggttggctcatggtgggtggagtggcacctggaattaggggtggctggggctggacactgggcatcatggtaggtggggccattgcacattgctgctgctgtttgatccgataatcttcaatcaattcagcatgttctttctgttgtttacgaatctggaataacaaaatgcatcattactcatttctatacagcataggtactgaagtaaaacactggctgatgactgtggttgaggttacacagagggcagtttggccctgcagaagcaaacatattttgcttgggtaactgcaaaagtcacaaaaaaattgaattgataagccttaactaacaactgtcaatctctttaacaacaggatttttataaagttatctgtaaaagtgcttcacatatgaaatatcaaaaacggtttagtaaaatattaaaatcttatggtgaaactcatatatactatttatactatacataaaaaatatacaataaaaaaggttacacaagcagctaattttgatgtcctagaaattacaatatacaatgttagaataacagacttaactcaaacttgaaccatttaaatgttaagatttcatttcttaaatatataaattgtacaacattttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccactgcgcccggcctgtacaacattttaagacaagatgaattaccagcacgaatatcacaccccccacccagattaaaaagactaaatttgttgaacactttcaatttaatggctaacactcaaattataatttctgaaatctatacaagctccgaggaagtattttgaatagtctgtaaatagactcttaatataatggctaatatcaattaattaattcattccaaaaacctttgtgtcccaatgtgctcaatactacaggccagatatcaatcaagacgcaaactatgttctggagaacctcaccatctcattcagcaagctagggaaagaaggaatgcaaaaggatgtgtatatctctcaacatcattcaatttttagataaatattaatatactaaactcaggagttctaatagtttttcaaagtattttcttgggttccccaggtagactaatactttctgcaaataatcgtgtttcatctcttcttcaacagttgtgtaactcctattttcttatttttcctggccagtttactggttagaactgagaaattaccattggttggtgaagtagtaagaaagtacagaaagcacctacaacactatgtgggatatataaggtggtcatccatgtctttcccatgatattttataatactttttaaaacattaccatcaactgcttatcttaatatgattatactggatctttggcaactatgtaatagatgatgtatcccatttttcaagtattagcttctaaataggatttgatctatggatatgcaaaaattaggccctcatcaaaagaccttgtacaaatatgccagatggcaatgaaagtgctaaaaaaaatatactttattaaacatatctttacaagaatattaacctacagtaaacatgaacccagagagtagatttaaagagaaaagaaacctttcattctggaataatcctagttttaaacaactggaattatgatcaccttattgttggtacattattgtggtagctgtggtttgaagataagacacgtgagtccaaatccctaatctaatagttataagcaaacatgtacagtgggggtattttttgggattttttttgttttgttttgtttttgagacaagagttttgctcttgttgcccaggctggagtgcaatggtgcaatctcagctcactgcagcctccacctcccggattcaagcaattctcctgcctcaacctcccaagcagctgggattacaggcacctgccaccatgcctggctaacttcttgtatttttagtagagacgagttttgccacgttggccagctggtctcgaactcctggcctcaggtgatccgcctgtcttggcttcccaaagtgctgggattacaggcgtgagccaccgtgcctggccacgtgtacacagtgtttataacctttacaatgaatcagtttgtaaaatggggataatactaactccttcagaaagatgtagataagacaacgtaaatggaagtgcttcctacagtgttcattatagagcactcacattttttttttttttttttgagatggagtctcactttgtcgccaggctggagtacagtggcgcaagctcggctcaccacaacctctgactccttggtgcagggattctcctgcctcagcctcccaaatagctgggattacaggcacacaccaccatacttagctaatttttgtatttttagtagagacggggtttcaccatgttggccaggctggtctcaaactcctgacctcaagtgatccacccacctcggcctcccaaagtgctggaattacaggtatgaaccaccacgcctggcctgaaccttaagtttttaatttacttgggtaaatatacctaggagttggctctgaacccattttgtacactactattgttttattttaaatacaatttttacatgtttcttcttttccagtatattattcagtttaaatattctgataaacttctggtttataatagaagataatggcaaaatgatttcatttttctggaacagtacttcacataagacataccaatgtattttaagaccaaaacattaagaaataataataatatcaactccaagtaaacaaaaatactccctgggcccccaattcttattccaaactaaacccagtatctccccatgagctcggtcctcagttaagtcgaatactctcaatgatgtataacagaaacatggtctttgcagtgatttcttagtgcagaaaaaaataacgtctccaactataccaaagttgaaaatagttcttcgaagtcgaaattatgagactcaatctcttttgtgtcatttatttagtatgtgctgtgaccgtcactttaagtaaaagactggagctgttatggctgcagttactaagaggtctcagagctgtcactttttggcaatgtacttttaatgccatttaatactagtcaaaaaaaatcactagtcaaagtcactaatgaacaacacaccaaaacattctactcattaattgttggtagtttctattttgcaaacctatttattacctgttctagctgtttctgaaccatgctttgctgttcagtaacatgcttgagttgttctgcatcttcctctggaaattcacgcccagctttcttggcagtacgttgtttagctgaaagggccttcttagattttctgtgagcaccaatttgttcttcaagatacttctgctgcatttgaagcagctgttgggtctcctggagccactcttcatactgcttacgctgtgaatcatctgaggaaaaattaaaattcagttgtgttaattttctaaagagtccaacattataagttacacaaatctattttgtaaggaagtagtttcaccatgaccacataataggaaatttgaaaacacaatactaaatattagacgattatgtaatgataaaatatcagattttagaaaaatatttaattgagaaagccagagaatgcacattcttgagatactggttaacttagcacttataaatattacaaatccaatcttggaaaagcagacttatgtaatgaaattctttttttttactaaacaaattctctaacccacaagccaaactacatactaaggtatacatgcattttatgaatacgattttacagattttgaagagacaaagacatatcccattaaggtctagcgcatagactaggaaatcacttcccatgttaattttcctgagtttataagttctttcctatttcttaataatgaaaaaatatcctaaacagagagaaaaggaacccagaatgttttagaatggaataatttaaagtctatgacttataaaggaaatccataagttgaaaacattggtaattattattctgtagttatattttttaaaataaggggagggaatagttaaccaagcaaaacattttctacttttacaactgccagtaattctccccaaatggctatatctcttcattttgtaccaatattctcttctttattctttaagggcactttacttcattgatacccagtccaaggggaaaaaaaaaaagtcatcgtatgtagtgaaattctgaatatacctttttgactcactacaagacaaagaaatgaataaatacatttctaagaaggacattcgctgaaaataacatcaatgataacagaatattgtcatacattaagaatccaaccaaagccaatgggcacaataaagccagaaaaagccagttggtatagttctttacttgtttttaatgcaaatatgtattcaaattatagtaacaattaatgtagggggaatttcaaaaggtcagactttgggtttgttcctaaacccagaagttccagtacatgtatgaacttgaaatctagtctactaaatttgaagggcattttttaagaacaggctttttcacaagatttcagaagttctgcttctggtagaatgagacctaccgcaaggaaagcctttctggtttctggaaccaggagagcagaggtgagcaaaatgaaaaataatggtgaaaaaaaagttagctaaacagtctgaagatttcagaaaggttcagtttggggagaactttaaacactatcctgaaccaccttgggacccctgcaaataactagaaaggattcaggggcaccttgcatacctgacctttacaccatgctgctaacccaacttactgctaagtataatccctttgtttttcccatttagtgtccttgtcacttaggaagacagttcttagagcaaaacgtggtttagttctatagactgtaaagtgcccaatctgtatacaaaaacagcaacaatattgaagagaatggggaagatggtttttctgtattaaaatacttttctgtaactataattcttcatgcacagtgaaaaaagcaatgaaaacacacgccttgaagaagagttgcctaatagggcagtgatgtttaataagacaggagggcacctgggcttgaactggtgtacctacactcacttcaggtttagaacagcacacatagagtgcagacaagcaatccccagaaaacattaacttattagatttatacttactgacaaagcctggaccaaaatttggaggattaggcctagaaatctgatgtgttatactgccatcctaaaataagtaaaatttacaaatatgtttattccacatttcagttaaaggggggaaaaaactttaaaagaaagaaagaaaaaaagaaatggaagaaaaaaccctttaatttcctaagatatcttttaaaggtttttttataaaaagtagagtgaatttagtggtggcaacctaattctgaattcttattactatctctgaactactatactgtctagattttggctgaaaacaattatgcttgaggtaaaggattattcatcagaaatataatacagggcaaatcaattactgctaatactaagcgagagatctatataaaaaatctcactttttgatgaagtttacctggtttcttcttcaatcaaacacaagttccagattgactaaatgccactccacagcatggttatttataacaaaaactaatgtctctaacatgcacaaatataaaagaaaaatacgttaataaaaatattagtcttattttctacacacgcctgtagtcccggctacttgggaggctgaggtggtaggatcgcttgagcccaggtgtttgaggccagcctgggcaacacagcaggatcctgttcccaaaaaaataaaaaaaataaataaaaagtatttaattcgttttattttcaagttaaaagtcttatttcttccaggtgactgaacaagcagttattaatctcacaagtccctgataatcacctaacaaattaatgttgaaaaatgtttatccagttgtcacaagttctccttaacatgagctgtatacaaggtaataattataaacttatactagcagccagaatgtattatgtgcaatcttcacaatactacaaagcagttggtttaacatttgacatattaaaaaacaagaggctaaagaatttgcccaaagttgcacagtaaattcatagtggaactataatttctttaaaaaaactcagctataaaggctatgcttttcccattatatcaaatggcttctgtttcctcttttaataatgagaagaatataattatcagcataataaatctaaagcataactggcagggcaaggaagaaaacaggacatacattatagtaggtagctccctttataaaaaaaaaatcactgacaaaaatactgcatgagttttacttccccagatactgcttgatattatattaaaaatatagcatatctttcaacaaggatgggaagaaaaaaggaaaaaacaaatatagcatattgttttctacttgctgtgtttgtttgtttgagatgaagtctcgctctgtcacccaagctggagtgcagtggcgtgatctcggctcactgcaacctctgcctcccgggttcaagcgattctcctgcctcagtctcccaagtagctgggactataggtgtgcgccaccacgcctgactaatttttgtattttttgtagagacggggtttcactacgttggtcaggctggtctcaaactgctgacttcataatttgcccatctcggcctcccaaagtgctgggattagaggagtgagccaccgtgcccagccattttctagtatttatagaagttttacattttaaatataatgggtttaattctaaaatgcaggacatgaaaatgtccttctggagttaaaaataagtaaataaaaataaaaccaaaagtcctgagcgtgtggttttgccatcaagtgactttttacccgtaagtatataaatccttttcagaaatcacagccaatttttttaaccttaatttgtcttttgtttaaaaagcagtaaagtgtctttttggttacttttggctgtgctgatagataaggctactatttaggttggtgaaaaagtaattgcggtttttgccactggcaaatggcatatggtgaaatccgcatttacttctgcacaaacctagtactactctctagcaggggacttactctaaagcatgagtttgctgggaaacagaaaagcgtgcattctagagggactcattacaggcagtgttacctgaggaatggcctgtggtccaaggttctgtccttcactgttctgtgttccagttaccacctggcccataaaagggaacctgtcaaaacagggtacacaagtatcaagtgatgagcgtttagaaattattaatattaattaaaaactgtattaggtgcttaacagttttctcttccagagaagaacagtggcaatttcttcttcatcaaaacactaaagccctacctttcatgtactgggcagatgtgatcctcactgtaattcgatgaagtgtgctcttagcaccctcatgttacttatgatgaaagtaagattcagagatattccgtaaccttccccacaaggactagtagggctgcaataagaagccagctaggctgactctagaggttttactctattatgtgcctcactccactttacgataaaatgaattcaagacttcagaataaaaataagttgatttagttttataacgaactctaaggaaatgttttctcattccagtctgtgttaaaaactaattgagagcttagttattttatattctaaaacaaaagacatttcccaatttaagaattttcatacattttcatacatttctatatctaatgttaaagcaaatcaaaaatggacgactgaccaagatcagtctgcatggttaaacgtgtttagagaaatgttactcattctaattaaaactataaaaacttcacagaagcattactgcttacatgaaagtatttcctctggcattatcaaatgctttaacgtatcaagatatacatacaattttaaaaatgtattccaaaagctgtatattactatttaagtactattaggatatagaatatgtttttaaattttttactcaggtttttcattgatctgtcaccctacccactgctacaggtctggtctaaatgatcttctaatctgaatatcacacatggtctatcatcctaactcaacatatcacactactctaagaagggactatcacttccatttctaaaaagcagtcagtagaatactaagccatatacctgatacatgactaatgtatctaaccggcagatgcatgatgctaaaagagcatcagatgctgaaaggcctcaaattctgaggtccatatttaaaactaagtgctggtcgggtgcagtggctcatgcctgtaattgcagcactttgggagggggaggcaggtggatcacctgaggtcagaagttcaagaacagcctgaccaacatggtgaaaccctgtctctaccaaaaatacaaaaattagctgcgcatggtggcacgtgcctgtgatccgagctactccagaggctgatgcaggagaatcgcttgaaccttggaggtgaaggctgcagtgagccattgcactctatcctgggcaacaacagcgaaactccgtctcagaaacaaaaaccaaaacaaaactaagtagtaaataaaactcagcatttccttgttttgaatatacatagaaactacaatattattagcaagtaccacaactatcaccaatagaagacagattattttcctatcgagtgttgcaggcacctaatagattagttatgttcatcattactttcaaattatggtttattgctaaatttgttaatactttaaggaacatatatacataaatttaattatattttaataactatatttcaagtataatcatttccttcgtaatgctatgtcttaaattttctgcatataaaacattctgagaatttcaaaggcttcactggaatccaaaaatattcaagacataaaacagttaggaatctctatgatagagaaatagtgttaataaatattgctcaataatgaaaatcattggaaaccactatctctactttgatctcaaaaatgcttcttaaccatgtccaaagtatctcaacaattgaaaagaattatacccttaagaattcaaatttctttgaaatatatacatcttaaattcgtgcaaattttatattcaattctataatcatccacattttttatataaaagtttttcaacaagataactagactaaattgaggctctatgcttactttattgacagaggttctcatatagtaatacacgtaagactcattcatgacgcttgctaaaaatacagacacacaggcaaccatctccagatattcttatttagtaggtctgcagtagagcaaaataatctgcattttaaaaaaattaccccataattctcatggtggtccatgatcaaaatttaagaaacagtgccatgtggttaacaacccttagagggcataatttcaaaaattcagatattgaaataacccctactgtcttctttaatgcgtaatttctgtttttctcctaagagagaaaagacaaactctgtaactccaacttccaactgtcctcttatctattccttgtaactttctttttctgattcaaaaccggtttgggaacattttattttagaactgaatttataattgctttaatcactcagtgtcttaactgaaaaaaatcttagataacatgaacaattctaaaggtatttaaaagagcacagacctaaatactttgacttgagtaatcaggaaatccaatcttccaaatctttttaagatgttttacatttaccatccttgagactaatgctcttaaactggttcttacactaatttcttaaattggtatagcattttgtatctgatcatatcgagctgatgccatgacaacttaaatagtgttgttcattcctagacaagggctttccattttctgtatgttttttctaaaaactagtaatgatttcatgaatgtctagatgcccagtagaaacaagcagccactccacctacctgctcatcaccattggtggcatgcccagattgttttgtgccatcactttatttatacctttaagggccaccattttggctttcattataggatctgtaattgcatcaaaatctagaaaagaaatataaagttacttatttcatagtaattagttcaacgtacactaagaagtaattcaaatattacaagctcttaaattttattatttaataatcattacagatttctgagatggcaaccttatcctgggtttaatcgcatctcagtagtccttaactgaatcatgctttaataccttagtcctgcaggaattaaaacaaaaagtcaagtttaagggagattataagcaataatctaaagcaatgcaattaatttcctttcatccaaacttttgcaatgctaatcagaatggcttctttagtaaatataacatcacaaataagaatttgcaatactaaggaattctactaaattagttatcactcttaaaagaaaaatgcaccaatttcttaagggtataacctctcaataagaagctactacgaaaaaacctatttgcatctaaatgaaaaaaagggagcaaaatgatgaaattggggatatataaaatggaatgtcaattttattatttagaataaggcacactgcttagacacgtgccctttgattgctaattcttattcttagaggcactgaggcattttgactgcattgcttttgttgtttttagaatcagtaaaccattagaaacaagttaaagaggtttatatagcaaaaaatcgccaagcatttgtcatacacaaaaggacagtaagaagctttatttccatcataattttcttaaattcatccttccatgactgaaaacatatggcaacaatggttggaatgtaggaactaagaagacaattagtttctattaaacaattccataaataatagaattgagggaagtttgtaactcagttttgaatctcttaatttacctggaaagaatctaaaactcttcgttgttttcatttttttttttttgagacagagtctcactctgtcccccaggctggagtgcaatggtgcgatctcgcctcactgcaacttccgcctcctgggttcacaccattctcctgcctctgtctcccgaataactgggactacaggcgcacgctgctatgcccagctaattttttgttatttttttttaattattatactttaaattctgggatacttgtgcagaatatgctggttacataggtatacatatgtcatggtggtttgctgcacccatcaacccgtcatctacattaggtatttctcctaatgctatccgtcccctagccccccacccccgacaggttccagtgtgtgatgttcccctccctgtgtccatgtgttctcactgttcaactcccacttatgagtgagaacatgcagtgtatggttttctgttcctgcattagtttgctgagaatgatggtttccagcttcatccatgtcctgtgttgcccaggttggtctggaactcctgagctgaggcaatctgtctgcctcggtctcccaaagtgctaggattacagccgtgagccactgtgcccagccaactgctttcattctaaagctcaaggagggccaagcagggtggctcacgcctgtaatcccagcactttgggaggccaaagcaggcggatcacctgaggtcaggagtttgagaccagcctggccaacatggtgaaaccccgcacctctactaaaaatacaaaaattggccaggcatggtggcacgtgtctgtagtcccagctactcgggaggctgaggcaggagaatcacttgaacccaggaggtggaggttgctgtgagccgagatcgcgccactgcactccatcttgggtgacacagtgagactccgtctcaaaacaaaacaaacaaactcctcaaggaggaatagaaaaactcagtgctttattccaactgtaattctaataataaaatcttataagcatatcgcatgccactctaatacccatagtaatatacgttgagactcaagaaaactcctaccaatattagggaagaacggttctgatcgctgacgaatcatggcttgcatctgtctttgctgctgctgttcttgcctttcttgatccaaaagatcctgtagaagtagaggctgttcttctagaagaaggggcctctctctattctgctgtgctaatgtttgaggaatcattagctgttggggtccagacatgctactggtaccagactgacttgtttgaggcccagtttgagttgcaggttttcctgtccccagactgtggttaactgttgattgacctggaatgagccctgggtttacctgcacaccctgagaaaaaacatggtttaccctagagactactgtcacattagaattcatggcattatccaaaacacggccaggcggtgctatgaaaggaggcaaacttgacacatgattggatggggaggccggcagagttggtggtggtggagaccccgatggcctaatgtctgaattatcagatttctcattagcaagtaaacttgagagaactggagttgatccagttatgccacaagagtttattacatcttgagcaggtagttgagtggatgcctgaatgacatttgcactggggccagcagtttctcgattggttcttttctcaaatagatctggatcacaaggatgcaaagaagtcttttctccatcatttaggtctgagtgagcagaagcctgtgagcaaggagtgtcaacattatctttattctcatcatttttttcagtttcacatttggattccaccttagaatttggagacagtacttccgtttttacctcattggtaacagtggattttttctgtggtgaatgtttatcagagagaaccagagttttgttttcttgttcctttttttttggttcaacagatacacactgattatctaacttatcatcaattggaaggtctagttcctcattaaacatgcttttcttatctcccatgtcaagttctggatctgtatatgcaatgatatcaaactctcctgaccttaagaggtcatccaggttgggatcattagtttccaaattatctaaagtatccaattcaactaccttgccatcctctgtatctaaatttaagttttcaagatcttcatcatctaagtctttgacttcaaccccctcaaggtctttaacatccagttccttcacagaagggtcatcagaatcaagtttttcctctagaccatcagaaggctgggtggttatctgtaaattatcagacgttgtttcagacggtacagatgttgacaaaggagcttctgaaaattcaccacctagtggatggttcagagtcctcatgaccatagaagatgaatggacagaatgaccttgctcttgttgagatggtggcacttgttccaaatctgggtgcacaggtagctgattaggtagaccctggggaggtcgtcgcatggggtctgtgtgtctagggcccggaaagtctggccggggaatgaagtttccatgtctcagattagaagatgcctctacaacgctgccaggtggagcactgaaaggcagccgttgccttccgtcaggagccctatgtctcagttcaatatatgcttggcccagtatgttgtgctgctgaactggcaagctctgtggtgaaaaatgctgaggaagtccaactggattattcatttgtgagttatttaaaggcctaggcatatctacagatactgatcttcttagctgtggagaaactccagatccctgtatttgctgaggaggcacaaggaagcgctcttgactcggcatggtaccatgactacctcctggaaatccaaatcttttaaaaaaaaaaaaaaaaaaaaaaaaaaagcaaataggtattatgttaaatttagagttaagttgaaaaaaagaaaagtcttcaattaaactgtacatacaaaatgttgccaaatactatgacttacaaaagcaaagctatcaccattaaaaagtatttacagtattcatatgcaagtaagattttgctaagaatcctataatgaacaccatatctgagctctaaaggcttaagatttaacagataacaaaaatgaagacaaaggaagaacaaccaagcagatgaaatcaattgttcagagataagaacaatactactggactttttcaggaagagtttcttttatctatatttagggaggttcgatggaggaagctgattcggggatgatgtttgaatgaagataggtcttcatacctattgagggacttacaggcctcagtacatgagactacaaaggcacaggtttgatgatgggatagaataaacttagagaaaaggacaagtaggcctcatctataaagattaagtaaatgtataaattgttggactattttatattgtacttccttctagacaggattacaggcaacttacacagaatacaaagcatagcaagaggcataaattataacaaggtggaagaaaaaagggaaattaagagtaagattacaggcaacttacacaaaatataaaatgcagaaagaggcataaattacaactaaggtagaagaaaaggaaactaaaagaatataacatggaggtagagatataagactaaaagacataaaactaaaaagcatatcttaaagaactatttccttattataactagggcataggtttggctttgactttagccactttgaaaaaggaaacattcttatgattcatcaccactaacttacaaccctatctcaccatggaaagttcctaaagggaaagtcctttcagttcggaaatctctaaaatttattattattattttttaaattgagacagagtctcgttctgtctcccaggctggagtgcagtggcgtgacctcggctcactgcaacctccacctcctgggttcaagtgatccttttgtctcagcctcctgagtagccgcgaatacaggtgcagtgcctgccgccatagccggccaatttttgtatttttactagaggcagggttttaccatgttggccaggttggtctcgaactcctgacctcaagtgatccgcccacctcggcctcccaaagtattgggattacaggcctgagccactgcgcccagcctaaaattaatttagaatgtaaagttaaaaggtagaaatttggagagaggacaagtctcatcacatcgtaggaggctttgcctacgcagaatagctacattttgaggatgtcatatgataaactgcatcattaagggtgcaaggtaatgctaacacagttaatacttaaaaacaaaggtaatgttttcagagtctgtagagttcttagaggaaaaaaatgtctatgacctctcattagcactaaatagcagattatatatatttcaaaggggagaaagaagtagaaagcagtaacagcttcctgattaatactaacttcatttgtctatttcttttaaaaaatttttaaatttgttgaagaggttgggggggggggggggtggtctcactatattgcccaggctggtctcaaactcctagcctcaagcaatcctcctgcctcagctagtagctaggattacaggcacaagccaccacacccagctctgtttccctcttctaatagcaatttaaattcggcaggaaattaaaagcattacctaaatccatgaggtctcatccccatactagcaacatcaggaggatagggtccacgctgatcttttgggaaaacagcatatctaggtcctaaaggaggggcaacaggagacctaatgttcccaggatagggaggtgggggtctggtgaaagcctggttaacattctctggttgccagtgttgaagaggccctggatgaggcactgcgggtgagtcctgtgaccccttctcctgtcgacctgcaatcttcttctgctgttgctgctggagaatgatttcacgtaacttctgccgctaaatgggaagaaacaaaaatcactgggatttgtggtaattaatggctttttaaaggttactggctttttatttttagatatgggatcttgctatgttgcccaggctggcctcaaattcctggactcaagtgatcctcctgtctcagcctctcaagtagctgggattacaagcatgcgccaccgtgcctgacaggttagtggctttttaaatcctgatactttcattatgtggctatggtaatgtttcaaagtttgatgaaataccagttacatttaactattcaatatattaggaaaaataatttgatgatttgggtccttttccttgccagacaactatcacaaaacaaagctttaatatttaaggattcccctgcgaattcgtgaaaactgaaatcagatacagaataaattaaactggtgttaatttcatcaatttcatttttcttttttgcagtatgacaaactctacagaataaaaaaaataaaacattaactcctgtgtagaaattactcagtttgatgaaatgaacagcttcctcaaataatacatttaaaactgagaacatacaatgtgtttacctgtctcaatttctctgtatctgcttgggccatatttacagtattctgtgtatcagttactcctgaagttggcacaggtccaggaagttgggagacaccagagaactgctggccttgggagtgcattggagagtttgaagatgcacagaagctcccctctgatccaggccttggctgatcagcaacatcatgggcagtttgacttgttccaaaagagtcagactgagatcttggagtcattggagactgatcatagggatcacgggcagcagatggggaaacacggctaaatgtgtctgaaagaccaggtccagggggcctaggtgtctgggaacatgtatcaggtggccttaccaacgggccaggtaaagctggtcctcggttttgtgctgcttgcaggaaaggatcctgatttggcatgaggactggtcttgtcattgaggacctagtaaaaccctctgaaatccttggccttggtgttgctggtggctgagagtaagggacagaaattccaggtcttggtgttccaggaggatgagcatatggatcagaatgcctctgatttgttacaggtgtaacaaacaagtcagtttgtgtagatggtcttggggtttggggctgctgactatatgggtcaacagtagtaggccggggagttccaggaggttgagagtaagggtctgtattggacctagctgttcctgaagattgggaataagaatctacaacaggtcgtggagttcctgggggttgggagtatgggtcctgagatgttggccttgatatggttccaggctgggaaaaagcccttgaaggatgggcaaaagattcattcactgctggatgtggggtaaggggaggctgactatatggatcatttgactgattatgagaaaaattatctataggtcttggtgtcaaagcaggcctttcataagggtcaacagacaatcgccttgatgcctgtgacactgatccataaggatcctgagaggatggaggaggttgcattggagtcttaaaaggtccaggaccactatcaagaggtgcaggtgtcaacaagggtcgtgcatatgagtcaggtatcctttgtctttgaaacacatctgccctaggagatggtttagtaaagtgatcactggttccagctgctatagggccttttgcagtttgttctgaaactacaggagaccgggataggcccaaggatttgggaaattgatctgtcatcacaggcctaggtgtgtctggaggttttgcataggggtcattatttgtcgtggaagaagaacataaatctctgacaggggatggcctatttgctgttgtctcattcatttgaaggggcctagataccgatgataaaggtgtacagttttccactggtgcagcagaatttcttctggaaaaactatggcccacaggaggtggtcgaggggtaccaaccatttttgcatatggatccattggagatggtggtcgtgagttagaggacccaggtgaaaacacttgcggtgagggtggctgagaagtctgagcctgagaaagactatcctggatgggaatccgggatggggctggaggaggaggtggagcttgtggctttacaaacacatcatctgaagatgtagacgtaggggtactgggtggctgttttgtaaacagttctttatggaatgactgtgcaggagacatatttccattgccaggctgaggtgtcaagggactctgtatcccactacttggtgtatctgaaccagactgcaccagaagatgctgagaaccaaattgctgttgttgctgctgctgctgctcatttttcacctgttcaagtttctgtgtggcttcaattttagcttgctgcttacttttctgacgcatttgctattaaaatagaaaagaaaaagcaatcatatttaggttaaggaagaaaactaccatcatggggggaaaaagcaacagaaagttaatttgtttgatgtcagcgctaccagattgctcccatattagattatgaattcctgaagaagagaaattactcatcatggtatgttccatttgtgcctagggcagtatattgtttataatatttcaataaatttctcaaatcaatttaaatatattttactgaaaagagaaacaagtctatcctaaatcaaattttcatggtctaagaactatattctaaaataataatgcaaagacctcccttctcaaaacaaaaatgcaacttcaaaaagtagattatccaaaaattccatacctgtctaaatttccattcctgttcatgttctgattctctttgctttaaaggatctttaaaaagctccgaatcaatacgagagctgggatcaatgctatcttgctgttgctgccttttcatggaatcatttgacatctgtactttattaatgcgtaaagcagctctgttatctctggctttttgctttgacaaaagaagagaaaaaaatttcccagattatgttaaatgttttaaggaataaaataaaactatcatgaactttctcaaataaaagaaaaaaaagtcaggtaaaatagctgaaatacttacggcacctcccaaaaaaggatctggacactaactcatcttctctctttacagtgcatagtacctatcagttgaggatatatttctatgtatttgaattaagcttaaagatcctaggtgtgatttaatattttagctcctagttttcttaacatatccttagaaattatgtctccttcaatttagaaagaaggggctggggccaggcatggtggctcatgctcgtaatcccagcacttcgggaggccaaggcgggtggatcacctgacgtcaggtgtttgagatcagcctgaccaacatggtgaaaccccacctctactaaaaatacaaaattaggccaggcgcagtggctcacacctgtaatcccagtactttgggaggctgaggcgggtggatcacctgaggtcgggagttcgacaccagcctgaccaacatggagacaccccatctctactaaaaatacaaaattagccagatgtggtggcacatgcctgtaatcccagctactcgggaggctgaggcaggagaatcacttgaactcaggaggcggaggttgtggtgagccaagattgcgccattgcactccagcctgggcaacaagagcaaaactctgtctcaaaaaaaagaaaaagaaaaagaaaaatcagccaggcatggtggcacatgcctgtaatcccagctacttgggaggctggggcaggagaatcgcttgaatctggaaggcagaggttgcagtgagccgagatcgcaccattgcactccagcctgggcaacaactgtgaagctccatctcaaaaaaaaaaaaaaaaaaatttagaaaaaaggaaaaatatccaatcagtcttaaaaaaaaaaaaatctggatatttgaaacgtatcattaaagaaatcacttaaaaatttaaaaattctgtcattacctaattcaagtcaaaataaaacacagcatattaacacatctatatatatatatgtgatagagcatatacacacatatatgctctatccaaaataatcactgtaactgaaaatatgtgcactggggaacaagctggaaaataactatatatattttccaacaataatacagatttaatatgctttaaaacgaaagcaaggatttggttccagctgacaatcttaatttggctctttgggagaaaataatttaccatatgaactgcgaatcttataaaattacctaatagttcatggcaaagatcatgtgtcaaaaactctttaaacatgtctaaatatttctctttcaagatgcacaaagattctctatgaaacctaacaagaaaagaggtgactgtggaagacactgaggcatgccaatccagtctccaaatttagtacagttgtccctctgtatccatggggtattggttccaggattccctgcagataccaaaatccacagatgctcaagtcccttatagaaaatgtcacagtatttgcatataacctacacatatcctcctgtatactttctccctttttattttttgacctagcagggtggtcttgctctgtcacctaggctggaatgcagtcgtacaattctggctcactgaagcctcaacctctcaagtctctcaagtagctgagactacaggcatgcgccatcatacccagctaattttttcattttttatagagatgaggttttggctatgttgcccaggctggtcttgaactcctgggctcaaagccatctgcccaccttggcctctcaaactgctgggattacaggtgtgggtcactgtgcctggcccctcctgtatactttaagtcatctttagattacttgtaatacttaacacaatataaatgctatgtaaatcgttgttacattgttttaaaaacaatgacaagggaaagagtctgtacaagttcagtatagatgtttttccaaaatatttttgatccatggttggttgaatccacagatatagaactcatggatacagacggccaactgtacctctgctgaagagataaaacaattttaaagtgaaatgaattactccttcccccctaaaacagctgattttcaatcttcaacgttttggttctattaacttgcttataaaaatgtcacactctctattaagacataaggagttagaaaatcactttaaaaataaagttgcttgttgtacaggtactaacaagcattttctgaaatggaaatttgttttttattaacctaatacaaataaggttcaagcactgtatttaaatatttaaaagatagaggagtttcttaaaataccacatatggtgctctttcttgtgagcttgcttttctccacaatttggcaatttgcttcactctagtagtccaatctgcaacaaaagaacagagtataacactttctcagagccatgctaatgatgtgttgtaataaagaatgttgatgaactgctgacagttaatcttattcaggccgtattctcatgaggtcatagacctatattaagttttttacaaagaacaaagatcgtggcacactgtaggccaaacaaacgttttctaaatgaagtgctgccttattaacaacgtagcttgtaaagttgggaagtttttagattcaagggacaaagtagcaaaaatgcaagccagacataataaattccctctggtggtaagacaccaccagaaccaaagtacaagtttgtaaaacatctgtgctaaacagaaatctatcaatttgacctaccagaagtaaacaaagtcataaataagcatctcactagcatttgtggacaacaaacacatggaaaagtaatgagttcaaaccatttatatgaaactcagtgtcatgacggtatacaaaatgaagaagcctgggtaagatcaacagttaatgataaatacagaaattatttattccacattacaaaaagaaagcaagcttccaaaaagccaatgaaaatgaaaaatcagttcacagaccaacagctttaacacagtatttcatgaggttcttgaatcacaaagtaaaattattaaagaaaattacttttaaaaaagttacagctctgctgtaaggacaatttgtgctgacacaaaatgacaacatacccatgtacgttcataaacagcaaatgtaagcatggaaagaaagtggctgaagaatgggatactgccttcacaggtctccctgcatcaaaccactgatttctattgttagataaaaagcatttcatttattacaatacataatgaataaagtcccatgaagacgccaatccaaaaaggtacctaaatacaggggtcatccaaatgaaaagtcacttccaggtacccctctagtaatttaagagtttgtgtattgatagatagctgggaaactattgcaaaactgagtttgaataactttttcaatcctagtttgtctgataccatgaactcaaaataataaaaccgcattgcttgcatatattcaataattgacatttcattaatccaaatttctcattcactggttaatcagaattttcacaaactgtactattatcatctgtttttttcaagaggcagtggtaatagctgggcagtcagggaaagtgagaggggaagaagggaagacaatattgaattcgtttcataaaaacactatttaggattcactgatttagcctagcagtatttttgattaaatgatagtttgggttctagaaattttttaaagaatcacataacacggatttctgcatattaataagtactgctaggagctgaaaaacggaccatttcactaattgaaactaatttttgggaaatatgaggatggatgcagggtctaggacaaagtaaaatgcaagatgtttctagacatctagggaatcttcatgttgtgggtcatcatagacaaaaattagttaagctacctttctattgcagttaaaaaaaaaaaaggtattgcacatgtgaaaatgttggtaaaacagaaataatatattcatggcttaccagggaattcttcctttaagttggggaaattaatattggtgtagagaactggggcaacagttgccatttcacccagagcctcctctttctcccacttaagcgtgcttctctgggcattcgacattgtgtcattttctccttccacagtgggagctgatgatgtccaagagttgttaggatcacttgccattggattaaaggctgaatttttatccctgggaaaaaataaatatctttactttatgaacataaaataacttcttaatatatgttcaagtatagctttcattaaaacctattacaaaacagttaaaagtaacatatttatagcaaaagccacaataaacgcaacatacaataatatcatacacaatcatttaagcagactaatttatatataaatcaaacagaaattagtgcaatttaagtttccatagaaaataaggcttgtacctggcatcaggataagaggattgtgcaattgcagagaaagttcccagtccgcttccaggtggcaaagaattatgtgggagatgaggactggatccaataaggccattcatgagaggcatccgtgaaaaagcatcttcagagaaaaaaataattccgttggcatgatattcacaagtaacaaggagttgaagtaaagctggcccttgaacaacatggtttttaactgcatgggtccacataaacacacatttttttcaactgaatgtggatagaaaacacagggaaacccatgcatagagaggaccaacttttcttgtatgccaagctccatagggccaacatttgacttctgtattctcagattttggttatacctgggggtcctggaaccaaagccccaagtacagaagagatgcttatacttctaaatcaaaacctttaatgcaatttaaaagtaggatttttttcagtattttataatacttaaagagtgacttttggctataagattttgaaatatgatctctacagctgtgattatttcattattgtgtactagaaatagcaagtgttctggagtccaaaagcccagggtgtgaacctcaattttacctgttagaagcagaatcaatttctatttctgtaaaccgtaggtattctgttatttgggttaattgagataatgtatgtacagctctaaacatagttcctggtatgcagtaactattcgacacaattaactcctaaaaaacactaatgaatcacagcaaatgctagtaagttttatcaaatattctttctcttcattaaaaatttacaaacagatgtttcttatattttattcctgttcctcttaataccaaaaaaaaaaaaaaatctatgattctttcctttttttttttttttttttgtttttgagatggagtctcactctgtcgcccaggctggagtgcagtggcaagatctcagctcactgccacctctgcctcccaggttcaagcaattctgcctcagcctcctgagtagttggaatcacaggcacttgccaccatgcccagctaatttttgtatttttagtggaggtggggtttcaccattttggccaagctgatctcaaactcctgcctcaagtgatccacccacctcagcctcccaaagtgctgggattacaggtgtgagccactgtgtccaccccacctatgattcttaaattgatactttctctaaattagttttgagtaagcaatatatctatcactaaaaatcagatgattattcctaaaaatacatacactctggttttggcctaatttttataacttacagttcagcccccaaacacatttgaattctcattcgagcttattcacaaacatcaaataccttatcgttttctttctgaatagacattaggcaaataaaaggaccatcttatgcttctttacaacactcctttaagcatgtaactccagtccttattgtgaaagtctacttgtctaaactatttggaactaagccaactgtccatattggagcagtttccagaaaaaagaaagaacaacaacaacaaaaactttgtttaccttcaaaaagccctcccaattaaacttgatgatttgtggaaatacacaaggcctctgttaattgttgcaacacttagagccatactattacaggagatccacatcaccaattaattacacaaatggcaatacagagttgaccaatacttggtataactagagaattcctaacctgatcacttgatttttttttatctaatgtcattccattagattaaaaaaaaagtctcatacacgtacattttacaatgtataatgatctttcacttaaaccacatcatttgaatgttacaacactaaaacctacatagctccagtatgtatgtgcagatactaaggatgatcactgacaagtttaaaagattttgtctcaaagacttcctagaactctctgactttcacaaacgggcttaccctactaaatgccacagctgggtccactggatcaggttttcacaatgacaaatatctcatgacacttacatttactccaaggattaaagggcaagatttctgcttttttcaaactagaatgccacatctattttcaacttcagtgaaaagcaggttccattaaggcaggggtccccaactctggggccacagactggtaccagtccatgacctgttaggaacccggccgcacagtaggtgaacagcgggcaagtgaccattaccgcctgagctccacctgtcagatcagtggcggtattagattctcatagaagcgcaaaccctattgtgaagtgtgcatgcgagcatgttcctatgagaatctaatgcctcatgatctgaggtggaacagtttcatcgcaaaaccattccccaacccaccaacctgggtttgtgaaaaaatggtcttccttgaaactggtccctggtgcgaaaaaggctggggactgctgcgttaaggaatgtgcaattttaataaacaatatcaaatgtctttcatgtaattaggagaaacaagagtttattgacaaggagaatgtgatccatactgtagctaggtatcagtgccatctaccgatattacaataataatcttgtaataatctacaatattaacatattgaaacttttcccaatagtaatattagctattatttgttaagtactttatgctatgctaagcactgtcttaaaagctttacagcttcatgaaaacccactgaaataggttattatgttcagctccatttaagcaaagaggacccacagaaattaaataatttgttcaaggacaaataagtaaaagcaaagtatttcttcttattttattcaagaagtggtcttttttttttccaagtctaccatatctacccaaactagtcatattagtttataaaagttcaaaagttacttcacaacttttacataaaggtatttcaagttactctatctcaatcttgaaaattctattctctactttctgaactttattaccatcagacaataaagcatattacatattacataataacatattacactttgcctcccctttctcatcaattctattgaagttactccactgaagattagcaacaaccttcccatggtccaatgaaacaatgtttttcaagtagtcatgttacttaactgtacaacctgtctctaatgatcattcatttccaagatcctatacctctcactcaatgtctcaaatctctcaccactttttttactttcacctaacctttaaaaggaagaaagataagaaacatgtaattgcacacctaatataaatcagatgagttaagcatatacttaattacatttaattaaaaagcattcctcgagattctatactctactggcagtatattctcttaataaatctcatccttcccacatgtgcaattagcacaattacacagataattcctacattttcatccatctccttgactaactgcaactgcctgtaagtcaaaatagtgtatatgtcccatttctaccaacctaaaagaggtctaaaactaaattcattgtacctccactaccttctaccagcacacacactaagtcttcctctgtttcatgattatcctctgggcccctggtttatacatagtctaattcactttaatttccccctttcctcacaccttatatccattcagtagcacagtcctacttgttctaatgtcattttctctcgtatctattccttcctttcaatcagcacggaagtatctttacatggaacctactttttaacttagtctcaaccacaataacctcattagtacaattcttctcgtcccaaatttattcccaatattgacaccagagctaccttagcaaaacacataagtgatcagatcacaccagtggtgtaaggtcttcaaaggctcttggaagcctctagggaaaaggctagctgcctctgcctatttctcagagccctttacaatcagcaccaatgtccacttctagttttgcttccttaaacaatgcccactccctttgctctggaaaacattaaagttgccattcttgaataactatgtgtcgccctatatgtaacttgatcatgctttgcccttacattagaactactattccttcaaacaagaacaatgaaatcttagtgattcacaaggctgtacttgaattatactgtactataatacacattagttgtatacctgaaagtctacagtattagaattacaaactcctaagggtaggcaacctgattcaccttgtattacacattaacaccttgcaaaagaaaaaaaaaaaaagaaaaagaagtcatcctcccaagaccttttaaaaatgagactgcacaatgaagtgattttcataatgattgtaagatgttttttataaagaaatacatctttgatttttaaaatatgcactttcagttcagaaaacataaagacaggtcatttttatatgttgaaaagagaaatactgaatagttcttaatcgttaaaacagcatatgggggctgggcgcggtggctcacgcctgtaatcccagcactttgggaggctgaggcagatggctcacaaggtcaggagtttaaggccagcctgaccaagatggtgaaaccccgtctctactaaaaatacaaaaaattagccgggcacagtggcaggcacctgtaatcccagctactcgggaggctaagccagaagaatcgctgaactcagagggcagaggttgcagtgagccgagatcacgccactgcactccagcctgggcgaaggtgtgagactctgtctcagaaaaaaaagaaaaaaaaaaagcacataggaacaattaaggcaagaatagttatatgataagtatattacccaaatgtaaatcacatgtttagcctagcaaaaatcaaggtaaatttatgtttagaggctaaactggtaaaaacacaaatatttccattatgtgcattatggaattttcatgtatatacaaagttgttagtaaaggttacaaattattcacacactttggcacttacacaagaaaaggagaagatatcctcatgttattcaattcagggtatagtcatgaggcagtgacaataggatagagagagatgttcctatgctcaaatcatcagaaatatatactagctgcgcacagagggccacgcctgtaatcccagcactttgggaggccatggtgggaggatcacttgaacccaggagttctagactggcctgggcaacaaagtgagacccccacctctgcaaaaaatcaaaaaattagccaggcatgatggcgtgtgcctgtggtcgcagctgcatgggaggctgaggacagtaggatcgcttgagcccaggagatcgcagctgacgtgagttgtgttcacaccactgcatgtcagcctgggtgacagagcgagaccgtttcaaaacaaaacaaaaatacatatagatagagttatatacacgccaccatgcaactccataaactccttcctatagattcccatacctgtaccaatttccctatctactcatacagaccttaatcctaggctatcaaatttcagctctacagaaaaggggagaaattggtagctagttgtaagtaggcagaagaaaaatgaacaaaataggcaaacattcacaaaatttcatagtgtctacagggatagaaaggtcactgatttactatgaaagtatgtactgaacacatactctgtggcagggcatataagcaagacatggacaactctagcctttaaagagctcacaatctaaagggaagacataattacccaaacaggtattatatttgtgccatatgctacaaatgaaaaacatgggggtggggtggtgaccagctaacctctgagagatgacagtgaaaccgagggcagatcaatgagtacaggcagccaggtgagcggggacagttccacacacacacacacagcaagtgcctatgtggcaaatgactagagtggagtgagctgggaatgggacttgcagggagggaagagggcaggcactgttacatcctccccactggacataaggataattacagaattacagagaatttcagggagaccgctatgtgaagtcagtatttttcaatcattacaaaagggtttttctccctatcagtttgtatacgtggctactaaagaatagggcaaaacttgcttgtgtgtgtatatgtacccacatatatacacatgtgtgtgaatataatgtagaattataaagtcataacataccctgattgtgtattggcaacagctgtgttggtgggggaggctgtggcaatggagttggctgagtgttcgcaggactaagtacagctgtaaataagtcttcaacatcttttccgccaagctctaggagataaaacaataatagtaacaagattaaaagactagtagggtcctggtatggggaacgccattttcattaactagaaaatcaaaacacatttacctggaattttatataattttccaagaattgctcctagaataaattaaaaaaaaaaaagaaacattaacagctactaattcaatatactgatataaaatagtatttaactgacagaaataattagaagttaaattataaccatgcaaaaatctttaaaaatcatatttactcaggtcttttagaaagcctagatgtagggcaaatattttaccatctgtgaccattttgtctagttcaggactgaggatcccatctagctgttcttcacttaatggtcgtgaactctgattgacatttggctgaggcaaagaggaaggatcatcagtgacaggaccaatatctacaagagtaaggaaaataaatttaaaggtacattcagaatactcacacaaaaatgtatagcactatttacctgtacttagtatataacaatatgattaaaatagagaaataaagtctgtaattctgaatcagaattctcatatcaatttggagagtcgctcagtaaaaattaggcacaatatatttgtattcggtgccatgtaaagttctatttcaagtaaaaacatttcctgaggaataaaagaatacatctgattttaacttgccaactcctgccaaaaaaaaaaaaaagcttaagataggagtttatgagaaatcgatatgcaaataattgctttaatttggaaaatagtgttatcaaatgtacagttcaattattatgcacagtatgtaaaaaggaatatgtttcatatgaattaatgaaaagccctaaaatgctcagtgtttaatattatcctttgtaaataacttcaattataggtaatatttttaaagtattctataggcacattctgattatgtacattacattttataaaattgtaacatgctgcagctcaaatttgtaagagtcacatgtaaaagtggtttatcatctacatttttttcatgctttctcaatattattactattaaaaagtaaaaatttagtctgttcttatttgatcttatattaggaactagctctacgacatttaggtaatattgtaaaccacatattaacaaaaataaaattattcattaaagaaaaactactgagaaagtcacccgaagtacagtacagctatactatgctttagccacacacaaaaagggaaaagcaaagtatggattagtgacaaattagcactactgataaacagcatgcacctacaggttgtttcagctgaaatcactataaaaaaagaagactacttctagtcagccgtcatccattgctcagtttcttaccaaatggaaaaggtgagctctcaacctggaaagtgcataaatcaagacctataagacccaaaccaaataaaatggatgattaccacaggagcaggaagtgagggaaaatacaaacaaaagaagaaaaaagatacagcaagactttaaggcaacatgccttaaatgtgatgcaattagaaagacgacagaaattaactaacttgctatacccctcctaaagcaggaaagctgaggcagatcaaagaaaatgctgagtcctttaacaaagccaaaaacaaaaacacagttactgggaaacagacaaaaggctaaacttgttccacacatcatacacctctcgctcacatcagaaaccagaaaaagggtaaacagtattcatatatacctgaatgatcaactgattttgctagatcatctgaaattattccaagaatgtcatcatctgtgtttaaaacttcagaaatatcagctaatgggtcatcagcaggacctaaatatagtaaatatgttttttaaaatttcagtattttctcagatattaagccatttgctaaaaacctagagtacagcagatactgagtgaggcaagtactggaataaaaacctgagactcttaattttacagtaaaaattttccatagcaaaggagataatgttttgaattacaaaaatttactaaaaattcagacgattttgtcttgtgactaatgtatattgagacaaaatttaaagacctgtaggcaataaaagtgaaacagaataaatgctgtaagaaacaaagcaaagaaaaaaaagtttttcattaagaaagtggcatgtctaaaagtgacattgagaaattaaaacacagtaggaaaagttaaaatatgaaagacaaacctgtcactctttagaaattccatatggagcacaagccagaaattccatatggagcacaagccaggtaccatctagtaactacttgcagctttgctgttcatactgattactcactcatttattttaaaaagtatttcactacccacagaactgtgtctatggatcacgtatcaggcattgcccactcagtaatgactgaaacaaagtgcctgccctcagagggcttactttctcagggggagttagtaaataaacgacatcgctgtaagtgctatttaaagaaaaaacaaggaaaaaggattaaaaataagctgcggggatgttgtattagacagagtggtctatgaagacctttaggagatgactgagcataaaactaaatgagggagtaagttatatgcacaaagatggagataaccctccaaactaaggcaaagcagacataaagcccctggggcaagccgggtttgccaacgagaggccagagtgttaacagtaagaaaaactgtggtaaggataaaaaagaggcagctagggcaagattatgttaagattttagagattatggggaagactgggttttattctgaagtgtaatgagaagttgctgggaggctgaaagataggagatgactaatattttaaagggaacatactggctgctatatgtagagcagatgaggggtgggaattagagaggggctggtaagattagaaaagggcactggtgcagtctgagaggtgaggtgatgacagcaccagggttctaaggaaagctgagacaagtggtcggctttgggacgtattttgaaggcagacacaaacgtggatgaatgaaagggaaagaaaagtcaaggaggattctacgggtttgggcttaaccaagaaactattggaactcttgtttaggctagctttaataattatattagtcattcagtaaagagaaactgaaatttttaatccatctcaagcttatttttacttaaaagggggaggagggcataaatgtaatattccaggtcaaatacttctgtcaaacagtcttggtcccattatatagttttcaaaatgtaattcatatgtaacatatcacattaagttttgcgtgcccaaatatccaggaactttttagagaaaattatttcaataatgacaacactgtagttgaatgaaaaaaaatctggataatttttttaggagtcatatagcagttttttgttttaaagtaatggaattctactatacaattataactaattttttaaagactgttttacaagtttgcccctacctaaaggattttatatctgaataaatcattaaaattgatataataggctacaatgaatgacatgttaaaaaaaagcctttagtcattaattttccattataaagtgaaaagagtagttcaattgcaaagaacaattaatctaggttttgaaatgggtatatttttctagtcctccaagttttggccttattgtaaaactgttctctcttcagtatttttgtggaaaaaaataaataaagaaaaaaaaaaacttgtatcaatatctttcctatatgttctctgtccaatttcaatccttttgcttttaaaactcaagtgcaaagagctcctatttaagtcttcaaagtggctagttatgagagttataagataaactttatcgtaaaatatcctttgaaggacccacaggtctttcattatacattatttttaacaacatactgacaaggacaagagcaggtcatacttaaaacaacagaattaaagtaggaggtaaaaaatatgtaagattgaacaaacaagaagcatgacctcactaccaacaatgaggcagactggacatgcacatgtgtccaacacggggtaagattgcttctaattatttcaaaaagtcaaaatcaaaaatagttgtcagtatttcaattcaggataatgccaagttaatgaagcattaactacttaacatccaaagtcatttttcagtggaagattgctttaaaattgtttttcaaaatgagtttataaaattaactgagtaacaaatgcaattaatggtaaaaaaaggaagcttaccaaaagaacaatgatttacaattgacagaaccataggggagaagtgggagaaacactgatcaagacacttacctacccaatgagttaaactcctagagccttgctgacattgctgtaactctgtaaatacatcaagttctcatacctttctctgattgttaatagttcctgcatttaggataatggttctcaaccgggggtgattttgcccaccaaaaccaaaaggtatttggcaatatctggagatatttttgatcatcatgaggccaaagatgctgttaaacatccttctatacaccagaaaggctccctcccacaacaaagaattactggtgcaaactgtcagcagtaagaaaccatgacctagggcaacagacttcactgtagtaacacagtatgccagcaagttcccaagtacccccacatccatttcggtttctctgttttgaatttaagctgtatgattaacaaaaatctatcttagatttttagtcaaaaagtcactgttggccaaattataacccctcacattgccctcagcaaagtgtaaaccaaatgttttccttcacaactcttgatgttggtactagttacacaggtaaattaatttgctacatcttatacacctgtccacttaaaatagttccacttactgaatgtaagttatacttcaatgctgttgatttttaaaatgcatatgaggccaaacaaaaacatttcaaaaagatttaactgaaaggaagatgtatgttatatgatataaagaaaatatctgtgaataattctacataccgtgagttccagattttgttggagccgaggatgaactaagtagtggatctaaggaaggatccaagaaacctgtgttcatgtttgttttatataaaagctgagctccatcttctgacagattatctaaacttatcttgctttgtctacttgtatctagaagatcttttccaaagaaagcttcctagatgaagataagcacatacaaaaatggttagaaaattctaaaaagacaatagattattctgtcatggtttttgacaaggaagcagaaataacagaaaaggtttatatttaacaatatagaaactgaatacagaagtattaaaaaatagaaatatcctgtcaattattttatatagattctccttattttaaaaataagattttttggtagctttactagagacaaaattatggaaataaaaccacacaattataccaaaggtttctagaaactgcagaatagcttcatgagtattattaatttttatagattacttgcagaggacagcataagactttgatctacggctttaatatttacttcaggtagatttgtaatctattgattcatataaccacacttacactataagactacttacatcatcaatctgaaagacggttttatagtcagtttagccatactatgtgtgcaatatttacagctactaaaggcttgtggttttctatttatttaggcatattaacatttttccatttcaatatactttcaagctgggttccttgcaactccaagatctctccaaaatttctcaaaaatcaataccaaagacaaaagggaagcacagttccacccctttaccctgcttcaacccaggaactctgctttagtctatatcctatgatgtagtctatctggaaaaaggatcctccatacaggacaattttgcaatacaacatttaacacattcttgccaaacatgcacaaaaaagttcactgtagcatattttgtaatgtcaagaagtaaaaatggccttaatgtctatcaacaggcatagaactatccaaattatagacacttatattacaaaatacaacaattttttaaaagtatatagttctatgttatcaaagaaaaagccctaaaatacattactaaaagaaagtaagttgaattacacatacagtaaattataaaatacaggtcgggcgcagtagctcacgcctgtaatcccagcattttgggaggccgaggtaggtggttcacttaggcccaggagttagagaccagcctgggcaacatggcaaaactcttgactctacacaaaacacaaaaattagccaggcatgcgccaacatgcctgtaatcccagctacctggaaggctgaggcacgagaatcacttgaacccagaaggcagaggttgcagtgagctgagatcacatcactgcattccagcctcagtgacagagtgaggctgtctcaaaaaaaaattagaaagttcaaatcaagactattataagtttgcaaaaataaattataaaaaagtttctgaaggacaaatgccaaattattaacaatactaccctttgagaaaagagattgggagtgtgtgaagtctggtggaggcaatgatatatctgatttgaaatgttcacattttaaatgaaaaagtcatctcactatgaaaaatctaaaaattcacaaaactagaataccaggtagaagaggattcatttcttataataagcaatgcttttatcattagaaaaaatgatgaacagcagaaagcgttttagaagtttagaggtcatttatttaatgccttcagtataaatctgagaaatcttacaccatcatcagcaagaattctgtctaatgactcatgactttactggtgtttatcaaaaactgtgtcacccttattaatttagtgtgttttacattccctgtagataacataaagagggggctccatccatatcgtctctaaaagtccaagaaaactaccattaaaaaggcctccctcatgtcacacatacagacacagacacacacacacacacacacacacacacacacacacacgctgaaagttactgatgtgcaacaggggaacaagacggcccaggagactaagatcacagcagtaattgggaaattagacctaataattttaaagactcttttgccaaagtattaaatggctagttttcatacttgcagaaacacctaaagaaagcttcttaaatttatattacactttacagaaggatcaataggaggaaaagtaggttgccatcacaatattcctagaaaggactattaagaagggaggtaaagggaatcccaggagaaaacaacaacaaagatgaaaaaaaaaaaaaaaaaaaaaaaaaaggtaagccaacctataaatggattttttttcctgaccaattaaatgatcgtttaaaaaaaaacaaaggtgcaaacctaggatataagagattgaggggaaaaacatgtatgaaggatatacaaaaagtaaggcacaggctaggcactttacatacatactctcactgaacttctgagcatttctgagaggcaccactatgtcacaaatgaggaaaccgagacacaagagatgttaaacagaacaaaatcacacagctaactggtagtggaatggtgtttaaatcctgactttataggctgagctctaacatgaatactgccattaagatgttagtagctacaaaaaagaaaattgaggaagttgtatgctagttgaaaggcaatgtattttaaaaccaattaaactagtaatacctaactggaaaattgatgtaaaaaataaatgcaactcaggcaatgaagggttatctgtgtaagccatagtttcttaggaggaacagatcagatgaatagttgtctacaatgaaatgaggatggcctctcaatgatagtctgttccagttcaattttaacacatgaagaaatagaggccaggaaggatgaataacacgcttaggaatttacaattagttagatgcagagccagatatttaatctcagtacaatttctaatattgagctgtttccgtatcacatggccttaaactctgacttaatgtttacaagatgaactagaaaaaaattttttttgtagtctacatctatcaaacataatttattcgtactgaaaggtatttttctgatgtgtattttggaaaacaaaaagaatactgcttaaatctttggttctccaggcctctaaaagtggtaacgattattaaagctataactttggctgaaaagcctatctttaatcaatgaatataattaatgtaacttgtattggcaaaggaaatttcaacagaacttgggtgtggggtatacatagctatcaatgacttggaagattgagtttttcctatcccaaagtgtccttgttacatcttatagaatgcttagaagtgaacaactggtattaaaaaagcaatttatgacaagtatcaaagcacacaaaaaaagtaaatttaatttttatggacccctgaaaggtaaaaatggcatttatgatgactaaatgacaacaaaacaagtaaaacattaacaaaaacaacaaacctatgttttaaaactcaatacattttatttcctcaattaacaaaccatgtaaaataatgtaaagcaaaatattacttgtaaataggcagggaaagtttcttcaagcttatttttcctttttcggtatctcttctttattttttcagtgctttcagtaacagaaacagattcatcaactaaagtatctggtaactgctcactccagcctgaaacaacagtcacatttataaatatgtgacatttaaaatttctagacaaacccactgaaggtaattttataccttaccaacatacacacagtttcatataaacaaacaagctttttgaacaaaaaaatctcaaatcaagtttgttacttttaagtgccataaaattttgatttcatgtctacttagtattagcatttttcctattttcttaataatcgattacaaagcaaaaacgtatttatttaaacatattttgttaaagagtaaaataataataataataataataaatacccaaagctcatgagtatgacgaaatggcaacttataaactattaagagaaattctgtgggtgtaacttttttgtagggtgtattgagaatactcaacaaaaaccttaaagaaaaagtgtgtcctttaatacagcaattccaagttcagaaatttattataaattatttgtaggatatacacattgtgaaaacatgacgatgaatatgctaataaatatgcaatgaacacttattcttgaaatcagaaatggaaataaatttggggactatgaaactagcaaagaaacaagaacacagcttaaatttgacaaataaacaatcaaatgatattctcagatgcttcataatggcagggcaaatggcacatcccttctgaaaatcaatatgggcactctaccaccagactacgtaagtgaattgactcttctgaaaactagaaatagacaaacattttttacaacaatctttttaaaggcaccagtaacctagccagaacataaggaatccatgaaaaacaaaaattaagataaataaggaaccacagaagtaagcaaaaaagtaaaagctctccgaaatttgctgaaatccaatgacctcaaactccaattttcagagcattgcgaggaatagggaatagaagacaaagcttaaggcctctctccaaggcagacaggccagaggtgacttgcataaagctcagggtcagtttaataagaaatacaccttcacacaaaccatcacttgccacctcctgctcaccaccaatagcaaaaaaaaaaaacaactcctggctggatgcagtggttcacgcctgtaatcccagccacttgggacgctgacgcacgagaattgcttggactcgggaggtgaaggttgcagtgagctgagacggcaccacagcactccagcctgggtaacagaggaagactgtctcaaaaacaaaattttttttagatatcagctgggctcacatttgtaatcccagcactttgggaggctgaggcaggaggatcgcttgagcacaggagttgcaggccagcctgggcaacaaagtgagaccctgtctttgcaaaaagccaaaaaattagctaggcatggtggtgtgtgcctgtggtctccagctacatcagaggttgaggacaggagaactacctgagctcaggagtgcaaggctgcagtgacccatgattgtgccactgcatgccaacctgggtgacatagtgagacccctagatagatagatagatagatagatagatagatagatagatagatagacagacagatacataaatagataaaaactgaggtgcactgtcacttgagaatttcaaattatatgataagtagctaaggcagtcaaagaaaggctttggagatgaccagaaagtaccttatgtaactaagttattcagtccctaaaccatttatatttaaatatagaaaatatatttaataatttgatacaggaaaaaagagcttgtcaaaaaatctcaaaagaataaagtctattggatttaaaccatttccttataaaacctgattactgtattacagatatgaactctatacgcactcaaatcctttcatcaataaaaggcaataagactcttattgagtaacaataagaggcaataaggctcttattgactgtaacattatttaggatagttttttccaatagaaatatcaagaccaaagggttacattaaaaaaaaaatttttttttaagtcagtactataccatcatctctgcaaggtaactgctcggaaatagagcctgaggaatcttttctgatcacagatcttttggttttcccttgcccagttcgacttctttgccgcaccataaatccaccaatacctatccaaaaaagaaattaggtaaactgataagtaatttctccctacatttccacagtacacaggataaaactgctttatcttgaatagtaagtcattttccaaaattaaatctgtgctaatctaaatcaataacctgatttttaggtaaaatagaagttaaaaacgaccaaaaaaaaaaaaaaaaaaggcaaagccactcttatcacttatcaaacagaatacaaaaagacctgtgtgcacttcctcttctcaacagtatcagtgtaaatatcaaacactaaattacgctggcttatctatttgacaaatattagtgcctcatacatcacataacagtcatgcactgcataatgatgttggtcaacaaagggctgcatgtcaaggcagtggtcccataagattataatggagctgaaaaattcccaccacatacagacatcaccgtagttataacaccgtagcacaattactttatttttttaaatgaatttagcgtaccatacagcctaaatgtgtagtaagctataccatctaggtttgtggaagtgcactctatgatgttcacgcaacgatgaaaatgcctaatgatgtatttctctgaacttaagtgatggatgactgtctgtatattaaccggctaactggtacattagctggaggatagaaggcacaaactacctagatgacacaaatattctttgactgatatgatttcagggggacggtgtctggtactccaaggtatgagggcatttatacatgggacacatagagccctgtgtttaacagcatggaatctggagtcagactatgtaattctgcttactaaatacttctcaatgcctcagttctttcactggttaaaaaagggggtgaggcaaagcagcttctcatacacatgttaaaaggacaaataacataagtgaagtgcttagaatagaggtctggtacacagtcaacactataagcttttgtgaaatgatatcgttgtctagcaatttactccgtgacctaatgggtccctcaattagagggttgacttccatgtgaggcagaggaaaagaaaaaaaaaacggtaaatacaagttcctggaagaaatctgcaatgtctaaaaaagtacacttataagcctcatgatcaggaagaaatgaaatcattttcataaaacaattcagaagcaactaatcttaggtccttattatagatatgacctatttaaaagataggttatcttttaaggtctcatggaatacgaatgaagtaagaaagttcttccttccatatcaaaagggatttagatcactcttaccaataaaatataagcaataagaagcataaagattgtacaaatccaatttaaaacctcattggtaaacaagatattaataaactgcctaaggaaagcctactcaacacgtgtgataagcgggaaaaaaattttttaaataaatacataaaagcctacaacttctgtattgtgacaattttaataattttttccaataaggcaaataaaactgacaagcaagaccgcttttctctccactcctgaggcagataagaaatgagtgtttaatcagtcatggtttttaactggactataaattctaggagccataataactctgtcttattccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcctttaataaaatggttaacatttgggacaaggcattcaataatgattcattgtgaagtattcacacattcaaaataaagaactctagagctaaaaagtcgtattcaaatagtttagttctttaatttatgtgcacatatttttgtttagacagttctgaagcctgaatatttaattttaattgaagtcttcagtattgtatttttctttaattaaccaagtgttgatgatattgaaatgtctacctcaggcactatacctggtctgtatggtttcctttttctctttttgacaccatctgttccttccactcccttagtttcatcatccacagcttcccgctcaggactagattctgattttccatcacaatccataagttctccttctggaaaaaagtaaatgtatacacaaaactggaaaaacctatcaaatatataatccctacataatggggaataaaaagtagggttgttgctgagccattttaattgtacatccctgttggtagggaaagtatgaaaggagatagaagaagccccaaatggttgtagaaattgtgctgcttagtgcagtgttcccatgaaataaaacataatcagagaaggggaacacagaactcagagttctgttaagtgcaatccatttgcacttaacaaattcacttgcttttaattatgtcttcaggtccaggtctctagactagaactctcttctgagcttcaaccacagctataattgaatattacctagttactgaaaactgtatatccaaaatgaactactaatttaaaataaactttctcctttttcccatgttacctatcatcattaaaaggcatggaaatgtaacccggagaagacagaggcctggaagaccacctcaatcattcctaatctctttcctcctacaaccaagacttctcaatacctctgaaatgcattttatcactctctactaccatcttagtccaacctcagatgactcactattaatacaacatgctcctatctagttccccaccttaaagcttacctctctccaatcagttctttaaattactgcataaatgatctttctataaatatgtatccattttctgcttaaaatcctttcatgtcttcccaatgccctcaaaataaactttaaattgcaaggcccattacaacagtctcttgtaaactttccagcttcatctcactcccaccagtgaactacactcagttctttgaatgtatcaagctctttcttccactatcttccccaatttctgccttctacctaacttatctttcaggatttattctaaacttcactgtattaaagaattcctgatatttagaaaagattatgtcaaacagttgtatgctcctatgtattaatgtcatgctttatttttattggttctttaaaatctgtgtccctgctagactatattctccatgagaacaggtacacagattttcttagtaacagatgtattgttagtaggatacctaatacatgttcaataaatacttcactgaatgaggtaaatggaatgcttagagaatgctattttagagaatgctattttaacactatggtaatcaaacttttccaagttatatatgctttacattgtattacaggaaaaagacatgtttatcaaatacattttaaaatcaagttgttaactccttcaatattctcagtattagagataacatatttcagtaatggcatgaacagggtatttgtcttttgttttttattatatttggtctatatttgaggccaattccataacaatctgataatggctatcggcttatgactaagccatgaaaagaaaagtttataggccaggcacggtggctcatgcccataatcccagcactttgggaggctaaagcaggtggatcacttgaggtcaggagttccgtaccagcctgaccaacatggtgagtctctactaaaaatacaaaattatctgggcgtggtggtacacgcctaaaagcccagctattcaggaggctgaggcaggagaattgcttgaacctgggaggcggaggtttcagtgagccgagattgtgccattgcactccagcctgagcagcaagagtgaaattccaactctcaaaaaaaaaaaaaggccaggcacggtggctcacgcctgtaatcccagcactttgggaggccgaggcgggcagatcacgaggtcaggagatcgagaccatcctggctaacacagtgaaaccctgtctctactaaaaaatacaaaaaattagccaggtgaggtggctggtgcctgtagtcccagctacgtgggaggctgaggcaggagcatggcgtgaacctgggaggcagagcttgcagtgagccgaattggcaccactgcactccaccctgggcgacagcgggactccgtctcaaaaaaaaaaaaaaaaaaaatgacagggaattttgagttaagatggcagactaaattcatatgttaaaattacattctcctgaaaccctactaaaaaacacactgaaataatctatttttaaaagataaaatcaagctgtggcatggtggcatgccggtaatcccagctatttgggaggctgaggtgggagaagagaattgcttgagcccagaaggttgaggctacagtgagttatgatcacactactgcattctagcctggacaacagagaaagacccaatctcctttaaaaaaaaaaaaaaaaagacaataggaaaggagaaaaacaacttaacaaaggcaaattctcagttgagagcagaaagaactgaaaaaaagaatccagtttataacactcctcagaaggctgagaaactaggaaaactggccacctttggaaataagtgggagaaaacccaagcaacaagagatttaattatctgcagaagtcatactccctacatctgcttcctaggtttacacactgagaagctgctactctcatttgtgggatgcaggattcctgggtgaccttaaatggaacaatgggatgaagactgaaaataggaccaagaaaatatgggcatactaaatgtggacaaccccatcctgctcccgctgccagaccccacgtttccccactgaattctcagaaagctagcagccagatctctagcctccaagtatgaggtttgaaaagactgcagtggggaacctgagcagttcaagaagaacatctaaagatacggaaaccagagggttcaccaaatggtcagcacaaatcaccccactaaacttacaaatcgacaagcaccaccacatacagaaagctttctaatcaactacttaattccttttttaaaaaataaaaatactatctatccagtctccatctttagttcttcacttttaatcatgcatgtaccataaagattatccgactatggtctataacaagcttgtccaacctgcagccaagatgctttaaatgcagcccaacacaaattcataaactttcataaaacattatgagactttttatgagtttttttttttttaaaaaagctcatcagctatcattagtgtattttatgtgtggcccaagacaatgcttcttccattgtgggccatggaagccagaagatctgcaacacccctgatctgtaacatgaaagacagagacctgagaacataaaagacaatttggaattaacagactaagtaggaagaaaaaaaatcttaaaaaagattaaaatcctctgagggataatataagatacccatgaggcaagaataggatgctacaaaagaaacattcaaagggaggaaagaaagctcttgaaataactgaaatagaaataaaactcagtagaggaagataaaataaggacatgaattggaaagaagcagagaaaaactgagtatgtttcacatctgaaaagcagaattctggaaaaacagagggaattgttatcaataatatagttcaagaacatttcctaccactgaaggatataagacagcagactgaaagagaccactcagtgcctaacaaaacagattttaaaaatcaaaaatagacaaaaacagacgttatcctcatgaaattttagaacactgaggacaaagaatttcccaaaatcttaacagcttccaagaaaacgcaggtcacatagagagaaccgagttcttcatatactagaaactaaaagacagtggatcaattgactaaaattgataaatgaaaatgtatttccaacctggaaaagatgagtcaggtaggaaggtaaaataaagacattttcagaagtatataatgctcaaaacttaccttccacacattctctgtcagggagctatggaatatacgttccacccaaatagagggaaaaaataaagagaaattcatgaaattgcagaaaacacatgtaacacaggagagaacagaagatgatctccaggatgatgaagaggaaatccccaagttaatcatatgtaatggtttgtggccaaggataacactggatctagtacaaaggccacctttcacctgaaacaatgcacacaaggacagtaaaaaccaagagagcacttttattgatgaggttcatagtgacaccagtaagcatacatgttgagacaaatggcataaagtagcacatacagtgccctcacacaggtggtatcactgtaggctaaagtctcttctaaccaacatcttcacaagggccttctgattcccacaggctgaaataaagaaaaagaccgtatcggccaggcacggtggctcatgcctgtaatcccagcaccttgggaggctgaggcgggcggatcacgaggtcaggagatagacaccatcctggctaacacagtgaaaacccgtctctactaaaaatacaaaaaattagccgggcgtggtggcaggtgcctgtagtcccagctactccagaggctgaggcaagagaatggcacgaacctgggaggcagagcttgcagtgagccgagattgcgccactgcactccagcctgggcgacaaagcaagactccatcgaaagaaacgaagaaaagagaagagaagagacgagacgaggacagaaagaaagacagacagaaagaaaagaaaaagaccatatcacccaaatatgagaaattctcccatatatacatacttgtatctagatgactaatctctggaaagctataagaaaacactggttctttccaaggaagggatggtcaaaaggtaggctaacttaacactgttcactctttttaagacctctgtatttcttgtatcatgcacaggtattgcctattcaaaaacaaacctacaacagggaaagactgaaagcttttcttcaatatctgctacaaggcaaggatgcctactcttaacacttatattcaacatagtcctagccagagcaatcacataagaaaaggaaataaaaggcatcagcagaaaaaagcgggtaaaattatccctgtgtgcagatgacatgatcctgtatgtagaaacccccaaaaattccacagttactagaataaatgaattcagtcaagtagcaggatacaaaatcaatatacaaaaatcagatgcatttctttatacaaataatgatctgaaaaaaaaatgaagaaaacatttccatttaaaataacatcaaaaagaataaaacactgaggaacaaatttaatgaaggaagtgaaagctttatatactaaacactataaaatattgacaaaagaaactaaagacacacagccgggcatggtggctcacgcctgtaatcccagcactttgggaggccaaggcgggtagatcacctgaagtcaggagttcaagaccagcctggccaacatggcgaaaccctgtctctactaaaaatacaaaaattggccaggcaggcgtggtggcaggcacctgtaatcccagctacttggggggctgaggcagcagaattgcttgaacccaggaggcggcagaggttgcagtgagcggagatcacaccactgcacttctgcctgggcaacagagcgtgactctgtctcaaaaaacagaaaaaaaactaaagacacaaataaatataacgatatccccatgtttgtagattggaagaatattgttaaaatgtccatactatccaaagtgatctacagattcaatgcaatccctatcaaatttccaaaggcatttttcacaaaaatagaaaacacaattctaaaatttgtattaaatcataaaagaccctgaatagccaaaagaatcttgagaaagaaaaacaaagtagaaggtatcacactacctgatttcaagttatattacaaagtgatagttaacaaaacagtatggtactggcataaaaacagacacatggatcaatggaactgaatacagagcccaaaaataaacccaagcatatattatgagctaatttttgacaagtccaataagatacaatagggaaaagatggtgtcttcaataagtagtggtaagaaaactagatatctatatgcaaaagaatgaaactggacctgatgcctatcttacacatcatacataaaaagcaactcaaaatagattaaatacctaacacctgaaaccataaaactcctagaaggaaatataggagaaaaactccttgatatcctccttgacaatgattttttggatatcacaccaaaagctcaggtagcaaaagcaaaaataagcaagtgggactacatcaagcaaataagcttctgcatagcaataaaaaaaaaaaaaaaacaccggggtgaaaaggtagcacagggattaggggaaaatattggcaaaccacacatctgataaggggttaaaatccaaaacatataaggaactcacacaactcagtagcaaaaaaatcccaaataactggattttaaaataggcaaggacctgaatagccatttttccaaagtcacacaaatggtcaaatggtatatgaaaagatgctcaacatcataatcatgagaaaaatgaaaattaaaaccacaatagatatcatctcatgtctcttagaatgactattatcaaaaaggcaaagacataagtgttggtgaggatgtgtagaaaacgaaacctttgtacatggttgataggaatgtaaattagtatagccattattgaaaacagtatagagtttccttaaaaaaaaaaaaactaccaccataagatccaacaatgcctctgttgggcatatattcaaaggtaataaaatcagcatctgagagagacatctgcactcccatattcatggcgacattactcccaatagccaagatatggaaacaaactaagtgtcctgatggacaatttacttacccattcaaggacagatgaatggataaagaaattgtgacgtgtgtatacacatatattaagtcctcccttaatgtcatcaataggttcttgggaactgagacgttaagctaaatgaacatacagcaggtcctcaagtaacactgtttccttcaatctaattttggcataatgcaaaatgaaaaaaaaatcagttttgtcatacttttttccccctcttaaccacagtttctaagaacttactgatgacaatgaggactttatacaatggaatagttagctttaagaaaggagacactgccatttgtgacaacatggatgaaccgggaggaaagtatactaaataaagtaagccagacacagaaaaatactgtatgatctcacttaataagcagaatggtaggcagcggggtgagaagctgaacgtatagagagtagaatggtggttatcaagggtctggaggtaggggatgggtgggatgggcagaagtaggtcggagggtacaaatctgcagttaggtaagacgagtaattctagagatcaaattaatacacagcatgagaaccacagttaataatattgtaatgaaaatttgctgaaagagattttaggtgtacacacacagagagtaactatggaaggtgaaggatacagacatttgtttgaccatagtaatcatttcactatgtatacaaagcatgttgtatacctcagatatgtgtaataaaaataaatgaaaaaaaaaactgtatcctacctgccaaaaacagttttaaatgcattatgtctttggatttagcaaggaattcacctttgcaggcccacttacatacaacattataaatataccaggtgattcattgtactattcacagtaaaagactgaaagaaagccgagcgcggtggctcacacctgtaatcccagcactttgggaggccgaggcaggcagatcacgagttcaggagattgagaccaacctggctaacatggtgaaaccccgcctctactaaaaatacaaaaaaattagccgggcgtggtggcaggtgcctgtagtcccagctactcgggaggctgaggcaggagaatggcgtgaacccaggaggcggagcttgcagtgagcaaagatcgtgccactgcactccagcctgggcgacacagcaagactctgtctcaaaaaaaaaaaaaaaaaaaaaaaaaaagattgaaagaaacccaaaggtctatcaacaggggaaagaacaggtaagttaaattgcttatatttccatacaaaggaatatttgcagccataaaaaaatgaaggacagtaaatagtagtaagacaaaaggaacaaaatatatatatatacacacacacatacacacacaaaatatatatatatacacacacacacacacacacacacatttccttatacatgcataaaacacatctggaaggttacacaagaaacctctgaggtttctggagatgtaaactgggggcatgaaggcaggggaaagggagagacttcactgtttaccttttaattattttccaattttaaatcatttgaatgtataacttgtctaaaaatcaaattttaaaagttgagggaattaacattacagaaagtaacaaacctcaaggaagcagccaccttcaccagatggatagtctacctcactcttcccactctccagtagttactgaatgccagtcccctccctccattcagtctgccccacctgctggccttctagagcctcagtgcagtcctattcccacacctcccaacacatccatacactgtgatggtcgatctgggaccaccagttgagaggaaatgtgttgtgtttccactcttgagacaaacagagtgttattttattgaggtatgggatttttttcttgcattaacagggtttctagatcccaggaggtgaatgagaaagaagtatgcttttattgcataaggaatttgtttctgatacaccaaagtgatgatgtatgacttttcttaaggaagcggttattagaagagttaaaaataaatagaaacaaaaagtcataggtattgttccaatactccaggaacatcacagtttggattctgtagatgtgtgtaatataatgtgtaatattacattctgacaacctcaagttgaaaactgcacagctgaagatcacttatagtcaataatacttttcaaactttaattttaaattcatcaagtctctccctaatgtattgtactttttaataaaggaaactgtcagatatgctataatacagaggaaaacgtttatatactctttcattataatttttccacaacttccaaaatgaagaaaaagacatggaaacattaagctcatagaataattgtggcagacaattccctcatcctaaaagttcaattaccccaacacaggcataatttcttactaactcaaaaggaactgaattcacatataaagacaagcatgggattctgttgagttctgttggacacaagacacaattgctcaagcactggttgagcacttgtattctaatagctcacggttactgagcactccatgtgtgggaagagccagtgctgggtgcctggcatgcatccttgcacctcatcagcacaactatcctatgggctcatcctggttcacctattttataaatgagaacactagcatcaaagaagttaaaaaatttgcctaaaaacacccagagtaggtttcatcattgcccactactttataatgttttcccaagggtactgagacattatcaaaacacgttagtgaaacagtctaaaacatcacaaattttaggtttaatacaaaatacccagaaaagggcagtgttattagaaatctcagcataatgtaataataagaacttacgatgattgtattctttccctattttttctcctgtacaggcatatgaaataccataaaacttattttaggggtgtgtgtgtacatgtagtttcaggataatatagtaatctaaaacatttttaatatggcaaagtgtggcaatactgaatttttaaaagggatttttatttagcaaacagaaagcaaaaatgttgtccaagtaacatgcacttattttatccctaggaatgtacctttccttctgcaaaggatgtgagatcctggcacgtaaatgaacatgagggactagtcatgaaaatgctgtatattcaattccttaaattctaaaattgtcttagcatttaacatccaacacactaaacaatcttttttcatattcaataaaaataaggacaaattcagtaaattcagatgggctattttatcacgtaaattttaaaaaagcaagggtaatttttcaactgattttcttttaccctgatacgagtcaatgagaaaatatgaaattgaaacatatcaccatttctcagtttacaagtggtagtcacaaggaaaaccttccaaggtcttttgtgttgtttttaaaaggtattataatctcataatttgggaaacaatgtgtactattatcaagaaacctttcatattttgtgaaatggagcacttcccaaatttaagagactatggaaacctttttcagacattttttaacatcctcagaaatggaaattcttgttaaagctgatctgatcaattcctcctaagtatatggactacttctttgcaaactccaactgcccaaatcaaattacctgttcaattgtatctgaaaatcagttacatacaagcatcagaaagtgtttctcccagtaacatagacccaaaacacactacaaaacaaaaattatcaagaacatacaaaagacatatcttttcatttatttatttattttttgagatggagtctcactctgtcaccaggctggagtgcagtggctcgatcttggctcactgcaacctctgcctcctgggttcaagcaatcctctgcctctgcctcccgagtagctgggattacaggtgcctgccaccacacccagctaatttttgtatttttagtagagatgaggttttaccatgttggccaggatggtcttgatcgcctgacctcaggtgatccacccgccttggcctcccaaaatgctgggattacagattataggcatgagccaccgagcccggccacaaatgacataccttttcaaagccacaattacctctcacctggaccattgtttctcactgatctacctgtcataactcttgcacctaatcatctatttatatcataggagagtgttcctcttaaaatataaataagatcatggtgttcttcttttcaggaacattcaatggcctcccattccattgctattaagcacaaactactgacacatcaccttatggttgtgtgagatatactgagccgtccttcttgtcctcacatctctaatcttctcaccttctgactgtcccctctgctcactctgttggtctccacaacactctttcttcaaacatgctcagcacactctcacccagagcctttacatcggcttcctcactgtctgggatgctcttctctcaggtaatcaagtggctcactcactcacctctttaaaatctgtgctcaaatactgctttctgttcatatggaccctaaacacccatctgtacttccaattcctttttttttttttggagacagagtcttgctctgtcacccacgctggagtgcagtggtgcaatctcagctcactgtaacctccgcctcccaggttcaagcaattctcctgccttggcctcccgagtagctgggattacaggtgcatgccactgagcccggctaatttttgtatttttagcagagaatgggtttcaccatgttggccagtctggtctcgaactcctgaccacaagtgatctacctacctcggcctcccaaagtgctgagattacaggcatgagccactgcgcctggccaggcaattcttatcaaactttatttttaccatgggacttgccaaacacattataattaactgattttttttaagagttgggttacctaacattaaaatataaactctatgcagagaattctacctgctttgtacactgatatgatttccaacatctgacatacagtagatattcaataaattctattgtctcaaagccagctgcagtggcgcatgcctatagtacctgctacttgagaggctgaggcagaaggatcacttgagcccaggagttggaaaccagcctgggcaacgtaacaagacactgccccttaaaaaaaaaaaacaaaaaactatgaaataaaatataatcaaacaaataattatcacttcatttctgaatcagttgaaaataaataaccgccccaaaaatgagcaaaccaacagtaatcctctttaactcatattggattttgggttactattaaaatattttgctatctcaagaactcagcaggctgagcagagcagatggtttgagcccaggagttccagaccagtctgggcaacatggcaaaaccccatctctacaaaaaaatacaaaaattagccaggcgtggtggcccgcatccatggtcccagctactcaggaggctgaggtaggagggtcgcatgaacccaggaggcagaggttgtagtaagccaagatcgtgtcactgcactctaacctgggcaacagagcaagaccctgtctcccaactgaaaaaaaaaaaaagaattcagctagaaaaaccttatatttactttgatcaagaaaatgtttataaaccaatactttatgatgcacactggtgaatatgaagttatacctgaagtaacattaaatgacagcttttccatttctagaatgtatgcatcaactaccttaactgaaacatggtattatccaagctcacagtatctgagaaggtttgtgtcgttatctagcaaactaaagtcaagccctctgtagttccccacctgtgatcttcaaagatatggtgctccttgagatttctgtaaggtaggtctgttctaaaatgtgtgaaaggaagagaacctgaaaaggcaaggtctaagaagatcactcatttggaaatggcaagggtcagtcacatcaggggttaactaagtcagtgtgatttaccctttggtaaatcatacacatatttcaaaagttactttatatgctttaattcttgcacacatatttcatggaaaataaattagtattacctcgactatcatccatttcaccatcccttgaatgctctgattggatgtctggaggggtctgaaggacggccacgctattctgatttataatcttcaatttcaattttggttttgaccgttttcttcttggaactgtaactgtgaggctctgtaactgagtcatccctgattcagtcaaacacacaccatcctgggtataagtcttgggtgggtctaaaattacaaaatcccaaggatacaaatttaaactttcatttcaaatttgactgattactgttccaaaatacccatgtcaagggaatgtgactgtagttctagaaagcaattacgtatctatgaaatgcatgaataattaacttcatgatacccaataaaaactatgaacaataggtcaaatttccttggattacaggcagaaaggttgcatgtttttaaaaaatggtcttcctgggccaggtgcaggggctcatgcctgtaatcccagcactttggggggccgaggcggcaggcagatcacgaggtcatgagatcgagaccatgctggctaacacagtgaaaccctgtctcttctaaaaatacaacaaattagccaggcgtggtggcgggcacctgtaatcccagctatgcgggaggctgaggcaggagaatcgcttgaacccgggaggcagaggttgcagtgagccgagatcgtgccactgcactccagcctgggcgacagggcgagactctgtctcaaaaaagtcttcctggaatttctattttcatgtcccaataaaaagagttagaagcactgcaactaaatgcaatgctcagctaatccactatgagcttcttcgtagaaaagatcaaaaggcagggatctatttacgtaagagaagagagaatactccagaagctcatctggaaaaatcagagtatcaacataattactaatagggagaagtaataaataagtacaaatcctgcagatttaattttaaatgtacaaaactgttgttccttagaacaattcctgtactatccaaacatttttgtatcaggtgctattaaatacaaatattcaaaagaatgactgtttaataagaatatcatatgaatcaccatactaggcttattaattattttaaaaattaagagattgaattaattctaaaagaaatctgttcgctaactaggccgtgttttctgctaactgataattaagcacagtaatatatcaatgaaactaaagcaagtatggcattaatggttattctaagagctgttatttttgttgcctacttgctgaaatttataggaatactgccccagtaaagctggatgacattttatatatcattgtggaaatgattaccaacattacagaatttggatagaacacccatatgattgaagcaggtttgacaagtggtaagccaattatgtaaaaattaagcaaagtaaattaattaaatcaagtaaagcatttcaaattttacctagctcttttacttttgtgacaatttgtgctacaagtgaagattcacagcagtctgaggaaggcactgaaacgaaaaaaaaaaatccaggtaattcttttcagaaaaggtaaagtgtatttaaatacttatatatgattataatttctgtttctatactcattttattaaaataaatgtttgaacactaaagttaaaagtgctttttaaagcaacaacaaaacaagaagtgatgaaggaaatactcaagtcatggaggaaaacctggctaagaaacaatcaacatattggattctgacatattgtcaataactacaagatcatgttccttggaagcaaaattatagtttacatctaaagtatatgctttttattgtttcatgtaaattgttttataacaagttgtgataagtcatgtataaccaaaaataatatttttcataaaatacttgtcaaagtaagtttcacaaagacaaaatagagtagagctaagctaattcattggttatggacagtaaggtgcaagtgagtggtacaagagtgcagactcacagtttaaattattctcttaccattagacgcaggcatatagggtctgcacatgctacaatcaaaaccaatgtctgctacattttccacttcttcctcagtatttaagttctgacaaactgcatgcatccatctaaaaagaccatatttgtacattttttttaaaaaatggaatatactgagaactgctaccttttaaaacctgtaacactgagtcttcaaacttaaaagccctaagcctcacatgctcctcctaccttgcccttttctcctaactatctctattaacagaaaaactttcatacagctaagaaggaaataaaaaggaatgagaacaactattagagaggaagcaaagcacattacataaggaagctaattattttatcatcatatattaaatatttcaaagacagaaaggaagctagttagggcaaacacaaaggtattcagaaaactgcaaatggcagtgctagcaggtatgtgctccaggtaatgcatctaacttgaagtagacatatctcacggaaagcgatgttgaatggtaatcgggaaattaagtaaaaagttgtcttgcaatggaacaaataattagtagccagagtcccaagaatactgtactactgataaaataatactattaataatatatgttcacttcttaacttctaaagagtacaacaatataccaatgaaagcaaggaaacattcttgattatgaaattccacataattacgtagggagggcagaaggtgctatctaatatctagatatctagtatctagagctttaagaaaaagtggtttaaggagaacagaatgtgttagatattttttataatctattagaagattcagaaacccttcataagaaacggcatagatgaaggcaataattctccatctaatttcaagggattcctaaaccctcaaaaaggcctaaattaaaaatctttagtcttgggcgggcacagtggctcacacctataatcataaaactttaggaggctgaggcgggcggtcaaaagatggtcaaaagatggagaccatcctggccaacatggtgaaaccctgtctctactaaaaatacaaaaattagctgggcgtggtggcatgcacctgtagtcccagatactcgggaggctgaggcaggagaatcgcttgaacccaggaggcggaggtggaggttgcagtgagccaagatagcgccactgcactccagcctggtgacagagcaagactctgtctctaaatttaaaaacaaaacaaaacaaaattttagtccggagttgagaattcaaaacaggaaatcgcttctgtaagtttctaggtgactaaaaatctacaaggcaaaaagttctgtacctaaaacttgtgattaaggaaaagctattttccatttgtttttttttttgctacatttcaaagagaaaagctttaaaaagatgaaaaaatagcacaatacctatcacattgtctacattgcagaataagatcttcttctctatagtttcgatagcagactggacaggaagataagcttgcacaaggagcgcactgtgtgtaattgttctgccattcacatcttagacctgcagatgttgctccacagtgtctgcaccaaacacacctgaaatccaaatccccccgaaaagtctcaattttattttcttagttactcagttactgtaattcaggaagctacatacgaacataatgggggaaatgatttaatgtgtatgtgaaaatttttctgattactggtatctatcatagaatatgtgtattattcaattaaataggtgtggctaatttttaaaaaccaaagtggtatgagaaagctctgaacttgaaagactaacaaggcaaacaaaccctagagtaccatttgcacttccagcctcctttgggaactgtctgcaatggagggtctaggcagtaggtgtgataacttatgtcacagtcatcacacagcaggagtcttcctgggtcagttgccttcccacaggcctcacacacagtgcactcaagacacctccaacctttgctaagaaccactttagtgatctgtaaaagaaacaaccaatccatgtgatttatgcattaacctaacataatcaaatatactatataaattaatatggtgcttatgtacctagaagcagaaaagaggcaatcaactaacatttattgagcacctacggaggcccaatactgggttgggcatgttcatacacgcttttagaagcctactgagcagaataatagaaaatggcacatattttaacgcctttttaaagtccacataattaccttatgctgtacatttaatgtccactatatttatagatatagtgaccagattttaaagaaatcaagtaagcttccctattattgatacataatttgaaaatacatcaacaaaatctccatctacatttccatgcttagaatcaatagaaaaaataccaaaaaaattaatgtaaggcatgagttcttagggacattttatgatcttagaggatttctatttagactatgaagctaggaattctgaagttcacattcactcctctgtttattctcccctctctcaagggtataagttagtagaatatttgggaatctccaaatccctaataaactcctgaaggaagccacaccatgtaatattaagattgtggaacttcttaaagatctcaaaagactaggatcctcagacagaaccaatcaagtgcccacattataataaaacagcaagtaatgagggtacagaataaaaattcagatcatgaggtacatgaaagcctaaaagctaccagagaagaaaataaaagagttaaattcaaaggaacacccatcagaatggcaccaaacttcccaactccagatgctagaagagtataagtttccaattctacaggaaaatacttttcaaagtacaattctcaacctagctacacaagcaactatgtgtgaagacagaacacgttgtagacacaggaagactcaaaattcagctccctcattctcctttctaataaagttacttagagatatgcggaacagaatgaggatgtattataaagaataggaagacttgggatctataaatcaacagatccaacaaaggacatcaggccaggaagtttaaggatgagaacaacatacctagaagccactggcacatatcagagcaggagaagggaatgtctagaaggagggtaggacttctcccagaaaaaaacagtactttaaaaactaatcttatatgatagttctagagtaggcaaaaacaaagaacgaatggagagtcactattactttcttgttataaaaaactccatgaaagacaaaagaaactcatagtatactgtttagacctgcagtgaacatttactgagtcataaccaacaccttattaattgaactaaacatagtaatacaactatattgggagaaggatggaggtgtattttaagacctaaatcagaatttatttattcatagcagaaagtcaacaaaatctagcattgataaagcagtaaaccagttgattatttagagctatagcattaaccacaagaaaaaaagacctgaaaagattaaaagcgactgcctcagacgtggaggtagagtaagacaagagttggttgttcattacaaggccttttttttttttttttttttttttttgagatggagtcttgctctgctctgttgcctaggctggagtgcagtggtgtgatctcagctcactaaaacctccgcctcccatgttcaaataattctcctggctcagcctcctgagtaactaggactacaggaatgagccaccacacccagctaatttttgtacttttagtagagatggggttttactgtgttggccagactggcttgaactcctgccctcaagtgatccacctgcctcggcctcccaaagtgctgggatgacaggtgtgaggcaccacacccagcccattacaaggcttttaatgtcatttgatttttaaacatgtatatttattattttgattagcttattgatttttaagaatttgtcttagattaccaagttaatgtattatttgcccaaatgaaggaaatggcctaggggtaagatcagggtggcttatggcagtagccagcaaacatttccaataaagggccagagagtaaacagaaagttttgagggccatatgatctgttgcaactttataaaaactctgccagtgtaatgcaaaaaccgctacaaatatatgtaaacaaaagaacatggccatatttcaataaaagtttatttgcaaacacaggaaatgggccagatttagtctatgggccagtctgcgtgaccctggcttaaacaatgacctgaagataaagtggcagacagatctgaggtgttcagtggcagaattttaaaaatatttatcttcattcctactaagttttcttcacagatacctgtggtcccttttataaccaaactctcaagtttctcagcttatattcactcttcaaaacactacagtctggtctctacacccacatccactcataactgcttaagccaggcttgtcaagaccttcttattctcaaatctaatggaaacattagtgtttgtgtttcttgacttctagtacttcaacacttcaacaatttctccctctttgaaatttccttttaacctaggtactggggttgtactatcatttttttcttccgttgaaccagtctagccttagttttaaaagttttttcaaataagatgtcatccaggattccatccatggtaccatgtccaaagttgttacagatatgttttataatctaatacggatacacgcttcaactataatggagtaggtgggaccagcctgttctcccataagatagtagaaaatgggacaaagtgtatgatacaactgttttcagatattggacaacacatagtacaggagacagtggtctctgagaggaaggaaacactcagggagtcctatgatattctgcctagaaacattttccagaatgctgcccagggagggagaacctcagcagagtacaatcaatggcctcgctgaggttagggaaggcaaggcagtggaatttgcaggacacagtactcaaaatgaagaagcaataacgactaagagctccagaaatctacaaaggatcccctgaagtctttggtggaacaccaagccgtacttctagaagcccaaagacccacaaccaggggaaagtacatctactgggaatttgtaagctgcacaattaccacagcttgcaaaaggctcaaagacaagtgaagcacaaccagtcagagtacaaagacactggtgaacagggagcagaattcagtagtgatcccagaaaggccaagtcttaagtatagggttaaattaatgctaggaccgcagctaccaaaatgtggtctagggaaccccagtgagtctgtaaagttaaaacaagtttaaataatactaagatttaatttgccttttttcactttaattcattcacaattatacagtggtgtttatagaggctacatgttgtatcataatattacattgatattgtacaggttgtgcttctgtagtcttgtgttataaaatgttcctagttttaatttctaaaatgctgaacagtccatagttaaaatcctcataaacaaaaactatggagtccccagtaattttaaagagtgttaaggttctaaaaccataaagtttgaaaatatccaccttagagtgaagactttctagacttgccccagcaagcttaaaaagaagcttcaaaggtatcaaacttatccacaaacaattgcctcctacaataaaaatgcaagctgagccaattcacatatccctagtatatttctagatactgctgtatttctcaatgagactgcagtattctatactgtccaaaacagtgtcatcgtgcaaaaggaaccatacataatttttaaaaacaggaattcaaattctagctctaccagtaactatgtgtttgatagtgcactaattgtccaatcttaacttatgtaagtcgtactcatctgtaaaatgggaattcggtaattgttggatgggttaaaagaaatacattactatcttgaaagggatcttattcaatttccttaggtccaaaacattaagtattctaaaaaacaaaatctaatgatagcagcaacttttatacagaatataaagtacaaagaagaaaagaaacatgttttatgcatatataactctattttttaattggctttatatactctgtgtttttcagtcacataccatgagcaactaattttaaaagactacataaattaaccgtactagtcttctattttggatagtattaattacaatctttcattttgattcctaaactcacaaaaacctgtattaccctataaaataaatactagtgtagttatcaacaaagaattctgaaggagataatgttgatttgcttactatactgacattttactgacaatgatataatacagtgatgtttgaagggcaggggagaaaggtataaaaatcactcatggttcacaacctgttactgaaactgaggttagtatttatattacatggtatggcagtactagaaaagatttccttgtggagtatacagtttaagacctctgctgtacagctatacctccatgcttgcttccagtggccatgacactttattcaaatatgtaagttttattaagactgagttcttaaaaagaaaaaaccaagaaccttagatacaactagtgaagtattgagacctgtccatatttaaaaccaagcacacgataccacttaaaaggttccccagaaagcctctatcctgaaatgcttcaaagtgagcagcgctgactctcgattattaccaattgcattaaatatgacacttgttttgtttcttttggctataaggagaaaatgtcattttgtatacgagtgagcatagaggagagagaatgcgggaaagaacagaatgggctaataattttttactaaatattccagttctcagctttttaaatcagcagacaaaatgaattagctaaacctaaaatctttgtgaatactataaattgtcttttaaattaaatgcatatatttttatgttttactttttcaagacaagtatattgtacaatataagatttatagaggagcaaatttcttgagataggaaacccttaaaagcagtattttaagtatttaaatactgtcacatatgtttaataatcataatacttaattgtgagaactgggagctcatgttactactaaaaccaaataaaaattcaatacatatttgttaactcaatttaaggatgtttaccttaatactgacacagtatggatggtaacactgaccacactgagaacaggcaagtaatcttccttctgctccttggccaaaactgccacaaactacacacatatcctgaagttaagaaaacagaacatattttaaatggagactaagctaaaaacctacaaattttactttaaaaataccttcttaactaatatagctctatagctaaatattgaatgacttctgtgtatatgagataaagcagaaatgtgcaaggaggaattcaatgaggaagacagtaaattgtcaagttcaaacctgattcaaagtgaacttgtcactgctagaaaacaacacaactgtattgtgcatagagttttcttcatcatccttatttgatgaaatatctgcagtagacacctataaaaagcaaaatacacagaatacgaagttatatttttcacttgttttacacttaactggaaagcttcagaaaattcataatcaaaacatatattttggctaaggtctagaataacaattccaaatattaatgctaagatactaccgtaaaatggagtcgtgacattttattattcacctaattctctctttagaggtagaattcctatagaccaagaagtaatgagaaaatataataaacctgtcttagtaagacttgattatgcagaattctaatcaggaaactataaatgataatatatgtatgtacccacacaaatctatcactattttaatgacacacacttgggatctgcaatgtagctagtctgaactgagatgtcctgcaaacataaaatacagcacataattacatattacgtgttgaaatggtaatattttagatatatcggtcgaaatggaaggcattaaaattaatttcgcctgttcactataatctttattttgttttgagaggagtttcactcttgttgcccaggctggagtgtaatggcgcgatctcggctcgttgcaacctctgcctcctggttcaagctgttctcctgcctcagcctcccaggtagctgggattacagttgtccaccgccatgcccagctaatttctgtatttttagtagagacggggtttcaccatattggtcaggctggtctctaactcctgaccgcaaatgatccactgcacccagctcactgtaactttttaatgtggttactaggaagttttaaattgcatatgtggttctcattatatttctattagcactgctttagaatattattttgaataacatcaaaatttcagtattagccatatgattatcaaccaatattgctcagtctggacttagttctatttgactaaatcaactaagtacccactggtttgttaataatttctagagtgattatgaaacaaaacaaagctctgaactagaagctgtagaagaagacaaggagggcattgccaaaatcataaaatacaatcctctttctttaaaaagcttacaacctaagcctggaaagacagagttgaaacacaacaggttatgttcaaggtcaaaacataaaacaactgaattacttttcttgaggaacaactgaaagaagattaaccagctgggtgtggtggctcatgcctataatcttagcactttgggaggctaaagtgggtggatcgcttgagctcaggagttcgagaccagcctgggcaacacggtgaaatcctgtctctaccaaaaatacaaaaaacagccaagcgtggtggcacacgcctgtagtctcagctactcaggaggctgaggcaggagaatcacttgaacccaggaggcagaggttacagtgagccaagattacgccactgcactccagcctgggtgacagagcgagaccctgtctcaaaaaaaaaaaagaaggaaggaagtttggttggttaactaaacagaaggactacatctcagtatttttcaatacaaatacatttaaaagcagtttttttgtttgtttgtttgtttttgagacagagtctcactatgtcgcccaggctggagtgcagtggtgcagtctcggctcagtgcaagctctgtctcccaggttcacggcattctcctgcctcagcctcccgagtagctgggactacaggtgcctgccaccatgcctggctaattttttgtatttttagtagagatgaggtttcaccatgttagccaggatggtctcgatctcctgacctcatgatctgcccacctcagcctcccaaagtgctgggattacaggcatgagccaccgcacccagcctaaaggcagttttaatggatagtactaatgctttataagagcaatttatagtcatatgaaccctaatgactacaagtgttaataatgccaatattcatcattagggagtaagtaaagcaatgacaaatccaaacattagaaaattacgcaacattttaaaagtagggaggtagaaacttgtatagactgccatgaaagaaattatcaaaagacgttgttgagtgaaaaaataaattgcagaacagtatttgaggtatagcactataatataaaaacatgcaaagtcattatatgtagtctatgggcatatataataggttgaatcataagaaattgctgcttttcatcagttcagaaataatattggcaatttcatatggatcaacctaatatataaatataccaaactgataacagggaaataagaaggactgaggagttagtaatggtaaattctgatctacctataatgctttaattttttttaatagagaaaatgtattgatgtgttacatgcatagtattaacaaaatcagctttctaagattttagagaatcatccaagatgattcacaaaagtagaatcatcatcatcagtaagaaattaagtgactactaaaagtaatcattaattcagtcatagaactaatgatgcattgacaagactattgagatatataattatggaaatggctaaaatagagataaagtatctatttctacctcccaaccactaacagaaaattcaacacattatacccactgagcagctcaaagaaattgtaaagatccattattatttttaaaaggaaatttaaccagtgaacgctttcactgaaaatgataaacaatatattcccagtataaaccagaaacaaagtctgcagtagaaaactacaatgtccctagattcaagtgggggtggggagtcatactgtcatatttaaataataagtgcagaaaaaccaaaatattttaaaataattgtccatgcaagaaagaaaatagtatcatctagcttgaagacccactgtttttattttataatttatttcatgaccgttagactgctagaaaaataaaacctaccttgagggcaaaggtaatctttgagaaaatacgtgctattgttgcctgcatagataatagtgtgatttatccagaaggtgatagaaatttcattttcctagaccacagatatgagccaaggagaatagaaagttctgacctaaacttcacaagtgtcccttccaagcagggacacgtaagagtaaacaaaaaaagaagatcaaattaaactcaaagtgagaagataggaaaaaataaagatgataataaaaatcaataaaacagaaaggggaaagaaaatagacaaaagtccatgaaaacaaaggctgactcaagaaggtcaataagattgataaatctctagccagactgatcaggaaaaaaataagacaagatgcaaattattagtatcaagaatgaggaaggtgaaatcattacagattctacaggtattaaaataataagaaacattatgatcaactccattcctttaatttgtcaagatagacaaaatgaacaaatttcttgaaagatgcaaatttatgcaaggagagacagataacctaaataggtacctattaaagaaataaaatttgttgttaaaaactgtcccacaggctgggcactggtggctcatcccgtaatcccagcactttgggagacggatcatctgaggccaggagttcgagaccagcctggccaacatggcaaaaccccatctgtacccaaaacacaaaaattagccaggcatgttggtgcgcgccagtaatcccagctactcagaaggctgaggcaggagaattgcttgaacctgggaggtggaggctgtagtgagcagagatcacgccactgcactccagcctgggcatggtggctcacgcctgtaattccaacactttgggaggccgaggcaggtggatcaggagttcgagaccagcctggccaacatggtgaaaaactgtctctactaaaaatacaaaaaaaaattagccaggcgtggtggcaggcacctgtaatcccagctacccagggggctgaggcaggggaaatcacttgaacctgggaggcagtggttgcatgagctgagattgtgccattgcactccagcctaggcaacaagagcgaaactctatctcaaaagaaagaagaaaaaaaaaaggaaaacacaacaaaaaccccccacaaagaaaatttcaggccaagatggtttcactaataaattaacgtataatataagaagatacatttccactactacacaacttttccagaaaactgaagaggagaatatacttcctgattcattctatgaagctgtagttatgctgataccaaaaccagacgaagacattacaagaatgtaagactacaggctggggcatggtgactcacgcctgtaatcccagcactttgggaagccaaggtgggaaaactgcttgagctcagaagtttgagaccagcctggacaacatagtgagatgctgtctctatcaaaaattttaaaaaaggagttgggtgtggtggcacacacctatgggcccagctacttgggagacggaggtgggaggtcgaagctagagttagctatgatcgcaccactgcactccagccaggaattagaatgataacctgtctcagaaaaaaaaagaagaaaaaaaagtgcacaggtctacaaccatggtgcatccacagttttattaatactcagcaagaaaagggagtacactgttaacaaatgcaacagcacagatgaatctccaaataattgtgctgaaataaatcagtccaaaaagtgtacagttctgtatgattccacttatatacaactctagaaaatgcaaactaatcttggggacaaggacggatggcagggggaatgcagaaaattacagaggggcatgaagaagctttgggagatgaatatattcactatcatgattgtggtatcgttttcaagggtgtatatatatatatatatcaaagcttatggaattgtacatgtcaaatatagcttatatcaactgtacctcaataagcctggttttaaaatttttctttttgaaaaaaggacaagaatctaagcttccttattcctggtttagtagtaaacttgaacaatttcacctgtctcctatacttaaaatgacatttcagaattttaaaaacagaattttaataaaatagcgaagttattacataaaatatttgctagttagcaaatatatttgcaatacacatataaataaagcctcataacatgatagtaagcaaatatctatcaatcttaaaattttttaaataaaagagcaactatattacatactgactttttagagagggttggcatagaaagataaggagtcaaagaggaaggtaagaaaagagaaaggatgagaaagtaaatatacaagaaaacataaccagaggctcaaaaaaaaaagcaaagtaggacagtaaaataaacattttgacctatttatatgactcttaagatcaaaataacttgctatgagattttcatcattaactgacatttagattagagaaaatatacatgaagcaagcctcaccccaggtaatacaacagctccgattccacttttcagctttgacctgcctcggccacctcgccccgacagtcctgcacctcgaggtctccgctttcctggaaatccagacccacggccctatgtaacagattgggaaaagtcaacattctgtgacagaccaaaataatttttaaatccaaatgccactgagataaaacattttattaaatgttacacaaacacttccttagataagtattaagagacctggcttattatttttatctttaaacgtatactccacaacttaaaaatctaaatataaaatgcttacaaccttagaatcataccttaggcctgtcactgtgaatgctatcagcaagcctttgcatgatttttctctttcccactcctacattcttggtgacgacaacaactatagcctgatccagatatttcgaagtgcaacaaattgtattcaatatagagtaagtataaggaagaactctctcattaactggtctcgcggtgattacaataatagctaacatctattgagtacttactatgtactaatctaagtattttttactctcaacaatcccatatagtaggttttattatccccatttgagatgagtgtgctgaggaataaaaaggttaagtaacttgtccaaggtcacttagctagcaagtctggctgcagcgtcccggggttggaagcatattctgtactgctacatcagcgtgaaagttcatttttgctagtgttgtgtaacagtattcttcctctcattaaaattaagtcagtttccttcactattcaacagttctcttatgaactcaacatttctacctcattcaccattgtatttagaggaaaatttatcattattgttattacttttatttttgagacaagaacttgctccgtcactcaggttggagtgcagtggtgtgatcatagctcactgcagcctagaactcttgggctcaagtgatcctcctgcttctgcctcccaaagtgccaggattacaggagtaagccaaagcgtccagccaggaaaaattatttgaggattataggaaagctgacaaaaggctttgtgaaagctttgctttaaataatctgaataataaatacttgaaatggaaataatttatctgacttcttacacaagaaataaacctatgggaaaatgtgttaaattccctgataatttcagacattaagtaccagagtatggtgttccctgccccctcacccttgtttgtactaattaattactccttgaaaaaacctggcacctccctaagtagatgaattatgtatatttaaaattatccagatgctcaggaaaatacttagatgtttccctcacagttaagttaaataatatgtcatatcttcaactgatgtcccttatcatagtttgaaatgaacttattccctatttagcagaatggtttccaagtcaaaaatttatggtgatactgtaagcataaaatagatacacatgaacaaaaggaacgggaggaatggcttttttccctttggatgtaacaaatacagccagctcccagtttcaaactgccactcctgtcttctcttaccctgctctccttgagatcccttttgagaagtgcatcagcttctttgcacaacagatggatggcgtcaggttagttttttgggggttttttttgtttgtttatttttgagatggagtctcgcttctttgcccaggctggagtgcaatggtgcgatcttggctcactgcaacctccgtctcctgggttccagcaattctcctgcctcagcctccctagcagctgggattacaggcacatgccaccacacccggctaaatttctttgtatttttagtagagacagggtttcaccatgttggccaggttggcctcgaactcctgacctcaagtgatctgccccctcagcctcccaaagtgctgggattacaggcatgagccactgcgcccggccgagtttgttttgtttttaaattggtataaaagatttttgaaaaattaagttagtgattaaaaatcgagactacagtaatctctcaatttattttctcgaacatgaaatgctgacccagaaaaaaagtaagtgaaaattggtggtctatattatcaaactgtcaaatgaggtatatttatacctcaatatcttggatgatatcagggggaggtagggaggttaaaaaacaatagttcttccagtcatgaaagaaaataaagtataatctagaattccttaaaatccttgattagtctaaattaaacagccatattccagaatattaaatatagaatatgaagaaaaactgtcatctccagtcaatgaagtattttaacttttgagttaatactttttcaaattaatttttttctcttcaaaatgcatcacactacttaactcacttcaaggactggcagagccatcaaccaatgtcatgggggaaaaagccttgtcattttaaggtattaaccagacaatgaaatatgccacaattttggtatttcttctccatgagaacataataaattaatggagctttttcttttgcttttttctaagcaacaaggttttatgatatcatgaatgaaaaggtccttaattaccttttggtctacatgtcaaggacttctccctcataaaaacagtagtaatcacaacaaaaggaattaaccataaaaagaggtattaaaaatgtatacttgatttttaaatgcaagcatattatttctttacattaaaatttttagatttaaaaagtgtttcttggaagctcaatctagaaaagaaagatttaattcttaacatccagtagggcaaaacaaatcagacagaaatgatatatgaatgtaaatgcaattttatttaccactttgatgctccaaatggcactgccaggaagctgcctgggtttaaaaatttcccgaccttctgaaatgtctggggaccaggaaggtgggctcactgtattatgggtactccaagccccctaggatatggcagttgagaaaatagatgtgtaaaactcagcaacataaaaggtcaaagccagcaactaaggaattttagaacagcaaaaacaaatgcaaacgtatggaaatttaggacaaattgcttcaaggaaggcaaaataagttaatcactaacagtgatttaaacatttaagtataacttaaatgtttgctgctacaatttacattaaatattttattctgcctgagacatcactacaatgaaacattaaaaattaaggtttataggacatcaacattgactcatgaactgcaattactgcaccaaaaagtaaataaaagtcaatcacactttaagaattaacactagaagaaagtattggggggttatttttcttctaacaactatcactctacttaaaaggagaaatggataaccataaggaattctatattctatagctataaacaaccaaaaccagtaggccaaagaatgcaaggagaaacataagcaatcgataaatgcatacacgttaaactgtagagagctggtaacattaaaatgcaaataccattataatctaagcatttaatcactctttcttcagtgaccattagttgtcggtttggttttggtttttacttagggaaatgaatactttatggaaattacatccaatggacaaaagtgaagaaacgttaaagcaaattgtcctaaatttgcaaattaaaatgcctaaagtacctgataaattatatagaaagtagtatcttattaaaatctatataactaaaactaaagcattttacttccaaacaaccacattcagcaataccctgaactaatctgatgaagatgctaaacagcataaagaaaaatgtttactccacaaagataacattttaaagaaaaacaagacaaatgtcaaacaataaaagaatatattttgaattaggtaattcaatggtgcatgctataattttaccaattaagtaaccaaaacttaagacaaggtacatagtacttaccaggtttctagaatatcatcaaattaaaaagtactatctcattaatcacataaaaataccaccaggaattaaaataaccagaaataagaatgtgactactcttggggtaagagataggtaatggaataacagtattttgagaaaagccacacaagcaatagactggtttcatttttaagtcacaaactgaatccacacacattgaagtccagcaatccaactcattctctccagcaaacactttatttttttccctccaggattaccgttaggtgttctttcttacccatcaaatctctaacctagctcaggtaatcactatgctgatttcactgagcagcaaccactgcaggtcaattacctcactttcataatttccaatcaacttgaatctgtacctatgtcttcttccctactattagtaaggaagtgttgtcaaaagccatttctcttttctcattttactcatgctcctgacatctggcatactgttctgctggatttggcagcagtccacctgtggatatttcactgccttcctcgctaatctttcttcatctcctgtacgtgttcttcctctatttgacttccaaagccctggagtttcccagggcttgagcctagatcctaaatggtattatctacaatgagggcatcttggaagttgatgcttcccatattcttatttctagttttaatcaaagatctccaaattagcaggattttcaacttccttcttagcatttccattttctcacacaaaacccctcttaagtttgccatgtttaaaatttctcccttaaccggtttcatcccagtcttccccatccttataaatggcatccagtcccttgtcactctcctttgctccttcagtcctctcccccaacacttcatcaatgcaaatcatcagcaaattcaagactttttatcttcaagttttgtctccaatccttctacttcttgtcacttccaccactagcagctcagtcgtggccaccaccatctctcacctaacctgctacaagagtctactgctggttatgcttctccgaccctgcatctactgaagcctttccccacagcagccagagaaacttttcaaaagtacaaatgtgatcaagcaagtcactattctatttcaaaccttcaattgcttctcagagcacttaaaagacaaacctttcccaatgcctttctccaactaaccttgtggcatttgtctccccgctgctacgctccagctattctggcttccttgctgtccttcaaacatgccaagctctttatcaatcagagcccgactgactcagaacacttcactatatcattccagcccctcaataaatgtctggcattttctttctttctttctttttgagatggagtctcgctctgtcacccaggctagagtgcggtggtgcgatctcggctcacagcaacctctacctcccaggttcaagcgattctcctgcctcaagtctcctgagtagctgggattacaggcatgcgccaccaggcccagctaatttttgtattttaggagcgataccatgttggtcaggctggtctcaaacacctgaccttgtgatccaccagccttggcatcccaaagtgctgggattacagacgtgagccaccacggccagccatgtctggcgttttctaacccttcaggtatggccttacatattttctcaacagcagacctttccttagtgctcccggtgaaccatcatctctcttaccacaccattagtgcctctcattgcatcaccacctaggacgttttattgtttgtaattttatttagtggtaggcagtgggggcaaaagatacctaaattacttctctcaatatttccattggtttttctctgagatttggctaacatacatcttaaattccttttagtcgatagtttaatattatgttggcagtagacagttctcaaaaatatgagacagaaagtcgtactctaagataaaaataatgttgaataattttatttcagaagtaagaattttctggtaattatgtattattcatcataatttaaaagttagctttgatgccaaaattttatctcacttcaaaaagaagacagactttgtgtaattttatagttctgaagaaaaattatcattatacttagatattctgacaaattatctagtatattccttagaccttaaaactaaaatatagctataattaccaaagtttaaattatccttcagatcttagctttgatcaagaacttacacaaaccactcagaaaaggttagctgcccctgtaatgtatgggctcttcccctacaatccagttgcagcactttttacactgtaattaaagatcatgcccctttctgttcactgctatgttaagcaccctgttcagcacttattgaactttttttctgctgagcatctattatctttttttgcatatgtgtatgaattcatcaataaacaatgaactatgatatgaaacacactaatgcctccaccagtaataacctagaatcttgaatttcttcacttaaaaaaagttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaacccaagaaaaataatttaacccaaaaacagtttaatattagcattaagtttctttctgttttgaggccaatttctcaggtaaactgtccaagctagtaagttatacaaggactgtgggatggggaaatgagaacaataatgacacgtggaggataggctatttagaagcaactttctattaaaagtcaaattctattgctggttgttaaatatgatcaaagtcactcttacagcccaagagtactatcagttttaaaagcagccagagaaggtttggtgtctcactggcaaactttacacctccaaatcctaaatcaaccccagccccacactcttccaacatactatgtaaaaccaaggttgcttataaacagtaagtctaatttaggaaaagtgaaagcaatgaagagagagagccgaaaggaagataactggtaaaagaaacaaaagagtttacagtttgtctttttggtaaatataatcacttgtatacagtggagctacagcagcaaacacttcactatttagggaattcttaaaagaagtctcatatataaaattgagttcgatatcaagtagaacaagaaattagacctaatcctgttttgataactacagaaacagctattatcagctttagccttcaataatttcacaatacaaattaggtggcactagcaacagtaatatctccaaaaataccacaacaagcacaagtgaactaaaaggaaagtctggtacttctaatcggctgtgttgttagcttggtgttccaaaggggtaggtattttttaggtttaacactatggttctctggctacttttaaaactgaaagtactcttcttataatataaagtaaacttcttataatttgtccaagagatatcaaaatacagtacctatgttttcatttatgaaattttcttgaaatatttactgtaggctgggcgtggtggctcacccctgtaatcccagcactttgggaggacaaggcgggtggatcacctgaggtcaggaattcgagaccagcctaaccaatatggcgaaacaccgtctctactaaaaatatttaaaaaattagccaggtgtgttgacgtgcgcccgtagtccccgctactcaggaggctgagacaggagaactgcttgagccagggaggcagaggctgcagtgagtgaggtcgtgccacaactccagcctgggcaacagagcaagactcaatctcaaaataaacagataaataagtaaaaataaaataaagaaatgtctactgcaaataatacgtttcataaaatgcttaataaaaactttcaataccatcatgaaagcaattagaacatgaaggtgtctgaactagatcatagtagtgtgattacattcaatatctttctataagacgtgatgatacatacagggtaaataatacaagaagacctaagattattatctcagaatttcctaattagaatgggaatacaactgtgcaatgagagaaatggactgaagacagaaataaaaacaaatgttatgatttaatatgacaaatttaaaatttccactttattttccaccatttttaaagagcattccttacagtattcagtttaatgcatttttaaaaatcagtaagacaagtagcacatttctctagttcagaactccgctttcagggttacagttaaagatgatcctagaagtgcattttaattggtctagggtagggccattagcttgatgttctaaaatctaccgagttgattacaatatgtggcagtgtcaataatcactttcttaaacccaggtcgcaaagtacatacacctataaaaatgctgaaaaatgggccaggcgctgtggggctcacacctgtaatcccagcactctgggagacccgagatggaaggatcgcttgaggccaggagttcgtaaccagcctggtctacacagcaagacccccatctctataaaaaaataaaaaatatttttaaatgctgaaaaatgaaatactaaattatttatgaatagataacttcaataaaagatgagaaaatacaactaggtcattaggacaatttgtatgaaacaatatccaatttgctgtctgttacttctcctaccttatcatgtctaatttttcctcatctttgtgaaatcctgcgtctacaataggcaagaaaacaaaaaacaaaaggaatcttattctattcacagccatcagaaaaatgtgttactattcctgtagtcagttaggttctaaatcatacatttgagatatatttgaaacatgtcataaagaaaataagcatcatatttctcactaaatagcacctgaaatattccatatgaaaggaaaaatacaaaaaactaaactttaattactaacctccttaaaggaaaataattctatatgatttgatatttgataatggatgtccaatacctgagatataaattccattttctgtgtcctaacatctcaccttcagaaaatctccaatattgggttatttggattatatatttaaaactgaatatacttgaaaatgtgaaagatttgttgcagcaacaaatggtttagcaattatctgcattaaaatgtgttccatgaacaacagaaaaagaatatttctacttcagtccttaaaaattgtgaaagcacagccacagtcttagtttgtcgatcttgaattcttttggtattttaatttcaccaataattccggaactgctgtttttatatttctcaaaatgttttgtcttgcatcgtccaataaggcagccaccatcatatgtgaccactgagcacttctaatgcagctagccagaactgatgttttaagtataaagcatcttgttcatttttatactaaatgctgaaatattgttttgaatataccaggttaaataaaatagattaaaatttatttcacctgtttttgtttttttaaagtgtaactacttgaaaatttaaaattacacatatggtctgcattatatttatattagacagcactggcttaccgttctactagttggctagcttgtacctccagataacatctgataatccaatcactagctatcacaaactagatctttcagatgtttcctattaaaatgttcgtttaattttgaagtgaattcctagaaaagctcatataatactattatagaaaatcattaaaatcaacttaataatttgcccaccatgaaacagaacttaaggtaaatctacatttctttggttagtatttactttactggtaaagaccaaagaattggtaatgttcaacaaaatatgaaaatgccagtgatgttaacaaaaaatagctggaaaccaaagaatcttgcttacatcacaatcacagccaggaaaatgcagcttattttacagccaatccccaacgtgaagaatatgtagaagaaacagtaaataaaaacagaagtataatacagaaatgcctaataccaaagaaattcatgtaacagaatactgaacttcagtatttctaatatacggatatacacattcctgctaactgtagaatatttcctgcaagttatggtcccagtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatacttacaagagtagcagcaaatgatgaagtagtaacaagaggggcagaaaaatagaaagattatcatcggatttgggaatcaaagacagctcagcaaaatactaggacatggctcatataagatggaataagcctggaaatacacccccctccccaatatttcggaacataaagtctacagaaaaagagtcctaatgtattgaacctggtttctcaattgaaacaaaagtctacaaggaaggagagataagtaaaatttaacaggaatacatatgaagcagtatctttaaagaatgtaaatatatcaaccaaaagtaaatttgagattcaaatttccattggtaaagtcttttcagagtcagaacaacataattattatataactattcaaaacaaaacaaaaaaaaacttactagaaaggagcacaactggtttgagaagaaaaacttttcatggtagagcagaaataactgtcaaggaaaatacttagaaaaaggcatatataaagagtggcctagttttactgcacacgtcttttgccatgcagaaacagctaaatcccatctgacaactactttccctttcgtgtaccttgtctttagagaataaaatatatctgggtttgatatagaggagactaattttcacattaaaaaatgattttcttaaaagcttggccttacagtttaaaaattatacgattaaaatcaatatattattcctataaaaagccaaactttaatccatttaaatcatgaaacttaaaacttaacttgaagcaatttcaatcatgaaacttaaaactccaaattactattgtgaattaacacttctccactatttgttatcttgcaattttaaaaaacacttcagaaagcagcaattttgtaaaacaataaataattcgtacctacagtatcttcattttgccatgcagttttacttaaatctcacttaaaaagaaatggaactcattcttaaagggtagaatgtacatgatgtaaagcagacaaaggaagatttatctttacttactgaaaatcaacagtacaattctaagatttttttccatgaaactactgaaataagtcctacttgaaaaaagaaatcccacaagagttagcaattaataaaaacatcaaaatgagaaattccccagcatggaaaattcctgtcataaatgttgatgtttatccagttaaaaatatatacaatgaataatatcaataaataaatatattagaaggaaataatagatgttagttactgtatacccaaaactatactgtattttaggctctatatttactgcagcacagaactaaaagaatttttaaagttctttctattagaaactattatcaataggttgcatctttatggcccaactgagttgaaattccaaataagatcacttcaaatttaataaatggcattcttcattaacagcatttaaaaaataatggctgaaacacataatcaacattacactgaagttctatctgaagacagaaaaagttgccatccacaccaaagctacacatataccttctgattttatagaattgttccaatatcttttctgtcaatatcattaaaatcaccctacctgtttggaccgaggtctaccaggagaaaattttctcttagtaatagctggtttacccatgccaatttttggagtgactgagatgtaagttgttggcatgatgtttccagcagaggaactaagagctgaagggtaattatgcagcatgtcatgcgaaggcaagtctgaagaaggtgttggggaggaagacacatctgccttgcttatgtctgctgatgatgaaaatgatgactctgtctcagatgataactttatagatttgcctccttggtatgaaacatctttcacacaaccctcaattgtaggagtcatttcagagtccatcaatccagtagaaagttcagaattttctttctgttccttttctccttgtagcctttctataaccaactgttcctcaggacataatgaaatactttcctcatgtggggacactaaggtttctagtggaagagtgacagattccatgactaattttggaggccttgattcttctctggataccactgtttcaggttcctctaacaactgcagttgttcttgctgcacagtgatctggtgtgtaacgacttcaatgttttctgtcacttccattttatcttcaatttgatcttcgccacaaatatgcttcacttcagaagacattttcaggtcttcactatcaacttcattagaaatctgtttttccaattcagtattcactgtatgttgggatgatactacaaaattcagaacatttgttatggcaatgtacaaacaaattttaaattttctaactatagatatataaaacatttggctacactagaacttaaatcagaaggtattcatcaaagcagacaattattaagtgaatgaaagccaaagtacacaaggatttatggattagaatcagccacacaccagaaaacctaatgaaaacattatgttttacaacttaaggatttccaaatggattgaaaattacacaggaaaagttctcatactcattttttagttaagaaaatgaggatcaatcatgttatgtgaggtacctaagttaaaaagtaaagagtgatctagaatgtgtaggcattttctaatagtagatacccagatgtaacaaagttactatagactcaaaagcacagacagaaaagatttactaaccaccaatatttattttgcttaaccatacctgccaacctacccaaaatattctttggatataatccttgttcttcatcactgtctataaattaaaagactaatctcaggaaatctataaacttagatatcagaaacatagtcactggtaaattttaaatcaggataccagtatgttaaacctttaactcaatctcatcaaggtaatttttaagttatagtaaaaagacactgctagcctcatttaccaatcagtgactaaaatttatctggtttttttttttttttttttttgaaacagggtctcactctgtgacccaagctggagtagagtagcacaaacatggctcactgcagcctcaacctcctgggctcaagtggtcctcccacctcagcctcccaagctgctgggactgcacacatgtgtcaccatccccagatactttttttatttttgtagagacagggtctcactatatcgcccaggcctatacatgttctgatatcaaactgaaatctcatcttctttcccactttattgaaagactacaggtagggataaaagaaaactaccaagtaacagatctgaaagtacaaaatatttttaatcatgacctcccccctccaaaaaaaaaaaaaaaaaaaaaaaaaacctttcaagagaaactaaccttctttagatccattgtcaattcttttccagaatctcttaactaaaagatttagttaccgtaatgtatatacatacagcaatcgcaaaaatgtctttgggataaagacattatcttgtaactcaatcaaattagacaatatgaacatactgcttaccagcaataagaagactatctgtgtcaagactttctgagggatgactcttctgttgctcttcagtgtggacttgaaccgctgtgagtaacacatttataaaatctctaaggagtcaaaatttctgtaacactgttccctcaacagtaatttgagtaaagagttttattctactaaatgtcaatttccaatataagcatgaaacattgtaccacttattagtaagttatgaagacaaaattagaagtctttgcactatggtaaaaattttttaattgtctttttctctttttctttaacaactagacctcacaagaaagattatagaaaataattttaatgagagttattatacgtaaacttaataaatttcaaaacatctcagtggctttttatgtatacattataatttttatgtatactatataattgaacatacaacttcacatacaacaccaaagactttcagatgagcctgtgattaaatgtaacaagtagttttcccccaacatggtctcttattaattccagatctgcaagtacaataatagctcttatcaatatttactacaaaaagcttaattgaaacatcatggaaataagtgaaataaccctcaataggactgctgagatgatccaatacagtaaatttttcattatctcagcatgaaacatctcatcatcagcaacagctctacttagcaactacaactaaagaaataaaaatacgaattgctttttaatagaaaatcacttggtcccttaaccaagtaagtacttatgattaagtctagatggtagctgaactacaaatacacgcatgtcctttctcctattaatttgtctaagattattttactaaaaaactcttcctaagtgactgcatcttggcttttactgaagttttagtcaatattcacatatttattgtatatacacattttcttcaaaaacagagtatatccattaaacattcttaccatctggaacaattccaggagtggactcctgaccgttgacatctttattagctgcctgctctgagaataccatttgatcttcagggccttcaacttccatttcattgttataatcttaacaaaaaattattaattctttagctcagaatgagtttttttctttgttcattaagtcaacaattatgattttgtatgagtaagggcaaatcatcaccaaaaatgctttaagtttttcttcagatttttctctgttgaaccacatgtatatttacatttttaaaaaacatgaaaattataatgcatcaaaaggtgggccaaccgtggtagttcatgcctgtaatcctaacactttgggaggccaagacggaaggaacgcttgaagccaggagttcaagaccaaccaggccaacatagtgagaacccatctctaaaacaattttttttaaaaggtaactggcacattattttaaaaggatatttcaaaactaaatactgatggcattctggaaatgaaaggttagtaattaagatgtttagttatccttgaagatgataaagagaagttttacaaaagctgccactcataatgatgaaaatgaaaaacaatctggcgagcagttctatttcctttactctctaagactcatgtttttaacagtaggatactactaaaaatattccatacctgaacaaaatcttgggctgaaaaggtgataattaacttaagaaggacattacaaaactacaacatgcttagagaaaaataacccacattataaagaacaaactaagcaaacccaaagactggggaacttccactgtcggcctgaagaacacaagtgaaggaaagcacactagacccggaattcaaatactaaaaaaaactatcttaagttagattagattttagccatcagattcagagatgaccaagataacaaatacatttaaaggttgagaaactgagaacaagatggaatctggaatacaggatcctctcttcctgattaaagcaatatattggtgatacaatggcacaacattacaaaaacaaaaaatttaaaaaaaaatcattctcaaatttacctgtagtgagctcagctatctccacttcctcacctggctgtaaacgatccatctcagctcccaggtgtttacaatacatgcagatatactcttctttgagctgagtatccagttcatgatctgttggtttgtcacactctaggtgaacccacctgcagtgataagtatacttaaataaaaatttctaacatcgagttattatctaggtaaagagaaggcattgctgaaaagctggatatgaaaacagttaattaagtatgagaggagagaggttagaggagttgctaactgacaaaggttttttaaagcacatttgtgcatgtcactagagatgctgccgtatttttacttgacatttttaagctattttctctttacttttccctattagtgctcatttctgatgtggtctggtcttatcttttgcccatttacttccttatgcctttgagactcaaaaacatcatttaattccatctataacagcaatcagtactgatggaattgctagagtgataaaaacttagaagctgtaagatggtagagcaaatgaccacatgaataaaacaatcgacaaaacaactgaatagaataactatcttcttaccttttgcacatattacaatgaagcatgtctttctgcaattctggatgataacacttcccacagaagggacataagttatcctgctgttggtaacaattgtcacatatcaggcaattgtggtgccactgagaactagaccgtgtgccacactctatacatattctgcaattctaaacaccaggaaaaataaaaacaaaaacagtttgttatgcatttgtaattgtagttctgatgtaaacctttaaaaagtcatgaatcatttgtggattatacattaagcttttattttcatgacactaatttagggtacatgctttttttttttgagatggactcttactctgttgcccaggctggagtgcagtggcgcaatcttggctcactgcaacctctgcctcctgggttcaagtgattctctcctgcctcagcctcctgagtagctgggactacaggtgtgtgccaccacacccagctaatttttgtgtttactaaagacacagggtttcaccatgttggccaggctcatcttcaactcctgacctcaagtgatctgcctgcctcagcctcccaaagtgctgggattacaggtgtgagccactgcgcctggccttagggtatacaccttttaaaaagctgttttcaatgtctgatgtggcctcacaaaatctgcactaaaatctccaggaaaatttaaataagggaatggggatatccaggaaaacatataggtggaagagataaaaccaaaaagacagcaactcaaaattcaaaaaaagaaacatatgctaggagcaggaagtaatttttgtggagtaagtctgctcaactctaaaacaatagcatggccagcctggtgtgatggttgatgccagtaatcccagcactttgggaggccaagatgggaggatcgcatgaagccagggatccgagaccaatctgggcaagaaggcaaaacacctctttctctacaaaaaaaaaaaaaaaaaaaaaaaaaaaaatttaattagccatggtggtgcacacctgtagtccctgctacttgggaagctgaggcaggagaattgcttgagcctaggagtttgaggctgcagggagctcacgccactacactcaagcctgggcaacaatgtgagactgccatggtgggtggggaaacacagagcacggtcaacgccatgtgacttggtgtctgaaaatgtgaaaatatattgctccacatcaaaagtccaatgatggcccttcatgtttttagaatagagagagtgtcctatccttaccaaattagaattgtttatgaagtaaaaggccaaccagaggccagccaaaactacttctgtgcctgtgagctagtcagccttaaaaccctgggtatccctgggtgtaaggttaatacattgtggggctctcattacccaccccaaattttgaatctaaaatatcaataaaagggaactttatctttctgtgctaccaggttgatatgaaagggatgctcacttaaaaagagaaactaccaggaaccatagatcagctagtcttaaagattaaaatgaatgcacttaacaacactgatgcaaaaatcctaaatagctgggcacggtggcacagaactgtggtgtcatctacttgagaggctgaggcagaaggatctcttgagcctaggaggtagaattcagcctgggcaacacacagagaccccatcttttgaaatacatacacatatattttttaaaagaatgtattatcctttatctaatgagaaggagaaaagaaaaacaatcctaaataaaatactatcaaacagactctaataccacattaagaaaataataactatgcccaggtggagtttatacaagaaattcaaagatatttaatattagaaaaatccattaataaagtttaacaaattaaaaggtctgaggagaaaaaattatttcaatgcaacagatgattaaagaaagaagtctttgggaagaatcaaaacccattactaataactcttgagaaagtaaaaatggatgggtatttctctaatgtgaccaacataaatacttcaattctaaaggcaacatcttattttatgggagagcccgagaggcattcccactaaggacaggaaaaagcaagggtgcctattatctccactactattttaacatggttctggagccaatgcaagcattgaaacaaatgaaaacagaaacataagaccaggaaaagaagaaacaaaactcttaatttgtaaacagagttggaacatcctagaaaattgttcaaaaattcaataaaagaattcaacaaagtactaggatataaaattagcatgcaaaaggcaatagaattcacacacacaaataacgagttaaaggatggtaagaaaaccccatttataacagcagaaaaataaatattcaagaataagcttaaatgttgaaaatcagtatgaagaaaattataaaacactcctaaaagacacaaaactagactttaacaaacttgtaaagacatcccttgttcttggttaggatgtcttaaaatcaagatgtcaatcaactctcacttatatatatatatatatatatatatatatatatatacatatatatatatgtgtgtgtgtgtgtgtgtgtgttttggaaacagggtcttgctctgtagcccaggctggaatacagtagcatgatcatggctcactgcagcctcgaactcctgggctcaagtgatcctctcacctcagccttctgagtaactgggactataggcgtgtgccactacacctggctaatttttttgtatttgtagagaggcagtttcaccatattgcccaggtttgtctcaaactcctgagctcaagcaacacccctgccttggcctcccaaagtgctgggattacaggtgtgagccactgcacccagacactcaataaattaaatgtgattccaataaaaattccaatgaggtttttattggggctacatatggtgatcctaaagtttatacagaaaaacaaatacacaagcacagataagaaacctgtgaaatggataagttctgaaggggcccaacattaccagatactacaaaggctctataacaaaaacagtgtcgtactggtgaatgaatagacagatcgatggaatggaaaagaggttccagatataagttcaatcaaatctaacattgtagtctggaatctcaagtcactagggcaaagacagtctttttaatgaatggtttttagaaaactgaatagccagttggaaaaagatactcacatcatacacaaacatcaactccaaatagatcagagatttaaatgtaaaaaataaaacaatgcaagccatacatggtggctcacaactgcaatcccagcactttgggaggccgaggcaggcagatcaattgaggccaggagttcaacaccagcctggccaacatggcaaaaccctatctctactaaaaatacaaaaattagctgggcgtggtggcgcatgcctgtaatcccagctacttgggggagctaagacatgagaatcacttgaacccgcgagggggaggttgcaatgacccaagattgagccactgcactccagcctgagcgacagagtgaaactctatctcaaaaataaaataaacataaaaactgcaaatcctagcagaaaatatgaactcctctataccctcagtgtagggaaaggctttctgaatatgactcaaaaatccagaagcaaaagaagattaataaatctaactccataagaaagaaacttttgcatggcaaaaaaaaaataataaaaacaaagtcaaaagacacataatacagcctggacaacatagtgagaccctgtctctacaaaagtaaaaaattagctgggcttggtggtacacataactcctagctaactcgggaggctgaggcaggaagactgcttgagcccaggtcaaggctacagtgaactatgaccataccactgtactatggccggggtgatggagtgagacactgtctcacacaaataagcaaaaaaaacaagaacaaataagctggcagaaagtatctgcatcatgtaacacagataaaagcttacatccctaacttataaagaactcttaaatttaggggaaaatgccaaaatcttcaataacaggcaaaacacatgaacagacaattcacgagaagaaattaaaactgacccttaaacacatgaaaaaacgatcaacttcactcaggataaacaaaaattaaaactacattgatacaccacttttcgcccagaagacagacaaacattcaaaagctgaacaagtcatcctgttagcaaagacgtaagaaaagttctctcacacatctctggtggcaatgcaaagtaccataagccccaagaaagggaatctgacagtatctaacaaagctacatatgtgtacactcctgaggcaataatcctacttctaggaatttaccctacagatttgtccctgagaattcaaaaacacacatgcacaaagctagggagtgtaaaatcatttataatgcaaaatatcgtaaactactgaaataccaaagcacaggccattggttgagtaacccatagcacagatacacaatggagtgctatgcagctgtttaaaaggagaatgagatctcttgaacttgcctaacttgcctggaagtgatttccagattttattacacgaaaaaagcaacatgcaaaagaacatacacaacatgctaccttcactgaaaataagagcaatatatcttcttattcttagacgaaaaataacaggaggtttaaaacagaaaacaatgaagttagttacttccaagaggttgggagaaatggagtataaataataaacaagaggcagtgacaattctgagtaaaacttcatatagtattgagttttgaaagtatactaatatcttctatatttaaaaaattaaatcactaagaaaagaaaggggaataaaatctattactgagagcaaactgaagcagacttgctttttagattgagcaactgaataaatgtgctgatgttgctacaacccagaatttttattgtagaagaacagacatgcaagaatgagaaggcaaagaattcagtggagaaggacaagaactggaggtactggtgtaaattcattatttctaagttatgcatatgtatatgaatatttatgtgtatatacgttaagtgtaggggtgttcaatgttttggcttccctggaccacactgaaagaagaagaattgtcttgggccacacacaagatacactaacactaacgatagccgatgagctacacacacacgcacacacacacacacacacaaaaaaaacacctcataatgttttaagaaattttatgaatttctgttgggccacattcaaagccatcctggaccacatgtagcctgcgggtcatgggttggacaaacttctgtaagtgtatacacacgcatgtatttcctgacaccacctgctgaaaggatgaagaagcaaacacccttcagtagcaatgagcacacccagcacccattccccactaaaggaatctgggttacttatttaacaatggacttattccagggctggggcacaggaggtataagatgagcttgtaacatcttgttacaccaaaaagtatgaagtgttcaagtaagtggtgagggcacaacaccagcgccagcttgaaggagcaactgacagcaagtatgggactatttcagccaaaaaataattaggtaatgagttgtaaatgattgaagataataggagctcatgagtcagtattaataagtaagtttaacatgtgaaagaagtgttcttgcttacaaaagaaagcagagggctaactggtaaatgcggtgggagtgctagagctggaaatgcatcatttgcaaccaaaacaaagcaggttaaaatggcatcatcaggcagtaagtttgttgttgttgttgttgttgctgttgttgttgttgttgtttttgagacagagtctatctctgtcacccaggctggagtgtagtagcatgagttcggctcactgcaacctctgcctcccgggttcaagcaattctcctgtctcggcatcctgagtagctgggattacatggcacccactatcatgcctggctaatttttgtatttttattacagacagggtttcaccatgttggccaggctgatctcgaactcctgacctcaactgatccacccgcttcagcctcccaaagtgctaagattataggcatgagccaccacacccagcctagggagtaagtttttcaaatctagaaggaaattctgaggaaaagcaagatatttgcatggtcttaaagtgtccttacatactgctttattagatacaaaggagggggaaaagaaattggacaacagcctgaccaggtgattcccatgagggaaagtggaataatgtgtgcttccagctgtgataccctgaggatggatcagtactttgcagtattctggccaataatgcatgcctctcatctaattataaggggatatcaaagacaaaatggggaaatttgtttgaaaaaaagaaaaaaacaagtatatcgagaagaactctattcttcaaaaataccaatgacaaaaactaaatcctagaacctacttggaggaaggggtaggttatgaaggacataagatcaaatgacataactggaatatggctagtacattagataaacatactacattgatgtaagtttaggaagttgatagcaggattgtgattttttaagaatattcctactattaagaaatacatactgaaatggtggtaaaaaggcacaacgtatgtaattaaccctcaaatagtagggggttagggggaatagagacaaaaacacagacacacacacgcgcacacacacacacacacacacacacacacacacacacacacacagagaaagcaagagagggcatgcccagtgacaatgaaatgctaacaactgataaatctaagtaaatgcgacatgggtattatttttattttctccaacttttagagtttgaacttattttcaagtaaaaactttctaaaaacacataacataccaacaaacagacattcttgagataaaaataggaaaaagaaacctatctgacaatgactggtttacaataaagatcctgaaaagattacccccactccagctcaccagggagcagccccaaactagactgacagccctgtgggggcacactgatttgtcccaacatctccagccttcactacagtttcacacacagtaaacactcaaaagttaaatgcaaacaaatgagcaaattatgactcaagactacagagagaactacagaagaatttaacagcagagaaagatgatcactcttcaaatggttcaaaggacaaacctttcaatccatgaaaaactctggtaactatttctgtacttactttgtgttaggcattgtgctgggcactttatagataccacttcattaaatccaacatccctgtgaggtaagtaccgttaaccttctatacactgacttagggaagttaaacaggtagccaaagatcatcaatttagtaactgaaaaaactgcattttgactccacagcataagctttgaaccaccacactatagtcccttcatagaacaggataaaaagattaagtatccaatagtattcccagaaattatgtaattctgtcactctcaaaagagaatagcagattacaaagagcaaattagaaagaagcacaccaaaggggagacagaacaagctgagaaagacacccagaattctctaccagttctcaagataatgaaaaccctaataaagaagatcaagagcaagaacaaaaattatccagtagttactagatattattagagagtgtaaagaaggtaattttttaagtaaatatatttttttaaaaaggtgctggggtggcgtgggggatggggactcacacatctcccaaagctttcaggaagaaaaaaaggattatgattaaattttttaaagttaagatttttcttgtgacagcataaactgaaaaaactgaagaaaatgttttcagagtataagaaagaaaaatttgtaatatgaaacattatactgtgccaagttcttatagcctaaagggaacagtctctttcagacatgtagggtttcagaaaatttataattatttttaaaggaacataaccaagactccgaaagattgagggtaaagttggaattaacagaggaaatatatttttgaaagaaaattgtgacaaggtttataatctaggttaatcaaatcaaacagagaaaaggggaataaaaacttcattttcagtggggaatgggagaaattttatatctttaacatttataatcatttacattcacaaaatgagattctgaattataaatcattgcaggaagtaaaagaagagaaaagtagaaaggaattataagaacaattttgcctcaaaacagccaagcatttcaattacaaccatcaatccaaacagttacctctattaagcttttcaaaagataacatttttataacacaaaagaatccaaaataaaaagatgtgaaaagataaccattcaactgttaaactaacaccctacgtggccatagtgtcaggcaaagcaaaatacctgcccttcctgatccctcaacaaaaaacacattacatagaataaagaacaatttcatactggtaaaaagcacaatatattaacactggcgtgacctacttgctaaataacagccacaaggtatttgtttaaaaatatgataaattgataggaacaattaatagtggtcaattgtaacaacttgttgaatcaacaagtcaaaaaataaggtaaaaggacttcatctaactaaatgaaattaataaacacaaatgctacacctttaaaaagtcactacaagtatcaacacatttattttaaaaaacctaccttagttaaattatctgattaaatgaaatgaaagcataaattaacatacttcagcacaacttaaaaaaaagataaagatattcggtaaggtatatacatacataaagttacaaatacaataaatttggcttcagccaaagctacagccgaaggtaaacttatagtcttaaatgtcctttttccttaggaaaggaaagaaaatgaattacaaattcaacttcatattaaaaataaaaaggcaagtagaggaactgagtgaagataagagtgtaaatatacaaatcagtcaaatagcagagtttttcctttccaatgataagtcattcagcaagagaaggaatctgaactacctgaggaagcaggccagagttcatcacaatccttcagccctcagaccccacttcccaggtagccacagctgagcacagttacccagcagctctttttccccccaggagagaaagcccctcccctcaacccccaccactcaggcagatgcctaataggacttgctgaagaccacaaaagaacctggtaatactgcttgcagttctaggtgccaaacctcactggcgaggacagggtgcaggtacagaatctccctgcgtctgctccacctcctcccccagctggggacctggggttctggccacatcaccctcctttcccaggccctccacctcctcactagaaaaagcagttccaagaagagcaatgacaatgctgtgccttccactcccgcacacgggccatcatgccctctccagctccaggaaaaacccgctccaggcccatgcagcacctgagggtcatctccatccctcaacctcgcaacaccagcagcccaggaagactaagcttaaaagctaaaccgcaccttggattccaagggctatctccactaccccactgcccccaacccggctctgaacgcctcaccctgaaggggcagaagccaagtgaggtaggaagttagttaatgagctcatcggcattttttgtaatagctcaaaattttgaaggacccaaatgttcaccaacaggtgattcaatacacaaattgtggtatctccagcactcagtaataaaaaagaatcactactgatctgtgcagcaatatggatgaatttcaaaataattacactgagttaaagaagccagaccaaaaacgagtatatagtatatgaagcttttattaaaaattctaggaagtgaatactaatctatagtgaaaaagcagactaggaagacagagtttgggtttgaacagccacaaagcaagccaagaggcaccaggaaacttttgagggtgatgactatgttcattatcttgaagagtgtacagtttattatatgtcagttatatgtcaataaagctgtttttaaaaagctgatggtgatgatgtacagatttgaataggtatccgatttgtctggtctccatataaaacatagagaggatttaaaaaaataaataaataaacaacttactttgcatttccagccattggttggtactgatttcataactggttgaagacaaaaagtatgataccctttgtcacacgtatcacacactagcatcttgctatcttctcccgattgtctaaaaaataagatagcattaatgatgccttatctttaaacttatgttttgtaacataagtaatcatgaaaataatcagtcctgggaactgcacagttcataaatacctcagtatctgttttgtctctgcagatagtaacagaggtaaccctgccataaggattacctcctaaatggtgatctttactcaatgctcacctatggttaacttgctctagccattttaggattcctgcaaaggaggaagggttaaggcaagatgaatagcctctgatctttacttttaaaatagaatttttgagaggaaggtgctataactgataggtgctactgtgtggaaaggaacaaatcttggcacagcgaattgaaaagacactgtcgtataacgtaaagaggatcaaatttggcatcagatctctatttgtattcaggctgctgttttctagctgtgtcactaaacaacttagactaaagctctctgagttccaggtataaaatgggaataataaagattactgcgagaattaaaggtaatgcgggttcaagtgcttagaatgtctattaagcaattaaatgctgaataattatttcaaaatacgaaccttgtcataattattaagaattatagttgaaaacctaaaatctttctctaaacactcttctgcccccaaagattgggcccctgtcctacagctttatctctgttgagatttttgactataatcactttcagatactatgattttaaattcaagaggaggggaaaagaaacaacagggaaagcaagaagagctgagagaggaatctctgaatgaaatctgggggataaatagatgtcaacaggaagatgggtcagttagcctccaattattattcagttcagcctctccataaaaagtcacgttttatctcctcagctacgtggaaagatcttggaggacaagtactcttccttcaagttcttttaatccttcccaagaaactgagcgcagatataaggtatcgaataaatgtttactgaatattttatctaatttttaccaaaatatggaggtacatagtcctatttatgtcacgtaactctaagatactgacgtttatttcttatcaaactaaataataaaaacagactgatcatggcagttgggcataattcttgctggttacaacaaaaattctcagcctgtaaatgaagatactggtaacatccccaaattatcatgctcattagaatcatgggggtgcaagcggaaatcacagaaaagactggagaaatgaccaagagatgaaataccataggaaaatataacccccttacaaatttgtaaatgccacatatttcgttttggaattatgctgaccaggatctactcaaggtggcttttagagagatgcagatgtacattaaaataatagtagaaattgtccttcctggaatggaaattcaaacacatgactgattttttggctcaactctaattcttctacttctgtagttagacgtttaaatcctattaaatctcctccccagtaccccttaagaaaaactactttattcttctgtttgttttaaattgttaatatcgcttattttttaaattgttggcaaatttaaattagctctttagacgaccagagcaatttaaatgattaaaatcagttttgtttagacttctttcaaaattatataaatgttatttatattataatataataacaaattatattatggatatatactggataaatgttataatatccagtaatttttttaagtatgatgaagtcactgaatgaatatagctaaaatatgaacaacctctattatattacacaaacctttagcacctagtaatagggtccctcttaaacccaatacacagctttgaattgaaatgaaaacttacttgcagttctggcacactttgcactcaggacattgccaacctgcacgttttaatggagtaaccgctatatccaggcacattccatgatagtgctgaccacaagtagtacaaaagaactgatctaagaggtctcccgggctgtcgcacactgcacagtttgcatcttccttcgctataattaacagtgaaacaatgaaattgttgtataagaatttaaattttttctgactatacagtaaaatcatttgaaaggatttgcatcatgaacctttcagacatttgaagttattcacattgaattgtcatctaatcagaaagaggtaccaataaaaacactgtagggtatttaatctaaatgtaaccacattaaatttaatcgtatagttttgcaattatttgtggctatatctacttgagaccataagcaggtcttctttaattttctattcctaatgccaatgataatgctggatacctaattaatgctcaatatatgcttactggaaagaaccaaacaaggaaaatacaaattaagaaatgctttgcagtgtaacataaacattttctttgaatgttaaatatattttgaaattacaaaatcagataagagacaaaattaagaaacattaatatcaattagactaagatgcttcttaagcataaacagactattcaaatcatataagggcttttttttaattactggaaaatgccttatgtggaagaacattaaagacagaagctacatattcatacacaaacacattacttaatatactaattatatattcatctatattaatttctagttgtaaaagcattaaaatccacataattatggacatcatccatccctaaatgtggattaaaagaaaatgtactaacagttcttttaccatataaaacagaaaatataaggataaactgccctgccaaatatacagttaaacttatgcatactgcaaaataaggaaaataatgtattctaaaatcataccaatcttagataatgtataaaaaatatgcctgtatataacaagtatcacaaagtatatgaatcttttcattttttgaaggtttgatcattcctatctactattctgactcatacgttctttcttttccagtcaagcctatcataccaaccttagataatatatataaatatgcctgtatttaacaagtatcacaaagtatatgaaccttttttttttcctttttttttgagacagagtttcactctgtcacctaggctagagtgcaatggcacgatctcggcttactgtaacctccgcctcccaggttcaagggattctcatgcctcagcctccccagtagctgggcttacaggcgtgtgccaccatgcccatctaatttttatattttcagtagagacggtgtttcgccacattgcccaggctggtctcaaactcctgagctcaagcaatcctcctgcctcaacctcccaaagtgctgggattacaggtgtgagctaccacactcagccttttttccattttgaaggtttggtcaatcctatcaatttctctctgactcacacgttctttcttttccagtcaagcatcttgaaacagagtaaaaatatatttcttttatttgtaccggagtctgcaaacttttcctgaaaagggccagatagtaaatattttaggctttgtgagccatagcagtctctgacaaaaagtcagactttttgtttttatttgcactcttttaaaaatgtaaaaataattcctcgcttgagggcagtacaaaaacaggcttcaaaatgtggacgctggctggacctctgacgtacttcatgaaggctggcttagcacctaatactcatctgaagctacattagtgaggttgccaatgcccataggaaacccgattgttactttttagtctttggctttttgcactttgtagcatttgcattgctagccactcccacattaaaacgcccctttccttagtttctatcatggcaactctctcctaatttctccttagttttcccttactttcatctcatcctcctttgttggcttttgtacctatacaatctttctaaatgctggagtttcttaggatttcatccttttccttctttcctaatcccccatagtttccctttgtgatcacatcaactctcatgccataaaatgccaccatgattcctaaatctgtattattggccctagaattctttcataaaccccaaacctttattcttcaagtcttactggatctcaatagccagatgttctaaaaacactcaatctcaactgctctaaagtgaaacttttttaaaaacccgaaacatcatccatttttctcaagaatagataaaggcagaaaccttagtatcactgttcactctgaactcagccctgacccaacacatccagccagatcccaattcttatgtattaaacttcctacacatcattcttccttgtatgtttatagtttagtctatcatattaggttggtgcaaaagtaactgcagtttttgacattacttttaatggcgaagactgcaattacctttgtacctacctaatactctgtctcgctaactgcagtatcttctgcatcaaatcatctctacttatggttctgacatcctgtctaaatcattttctgcacatccagaacaatctttcaaaaatgtaaatctaattgttaacctctgtataaattaaaactccaccaatacctcatttttcacctaaaagaaaatcagaattttcaagtatgaggcaaaaaggcccttatctccctttccaactgaatctcagaaccactcactatctcgtggtcatggtgggttgtctgccatgcacctcacataacatgctattcatgtctgtgtgcttttacacattctgttccctctgcttgaaattttgtttttctgctgtgctcccagccttcaaaactctgctcatggctgggcacagacactcacgcctgtaatcccagcactctgggaggccaaagcagatggatcacttgaggtcaggagctcgagaccagccgggccaacatggtgaaaccccatctctactaaaaatacaaaattagcagggtgtggtggcacatgcctgtagtcccagctactcaggaggctgaggcaggagaatcgcttgaactcgggaggtggaggctgctgtgactggagtttgcgccactgcactccagcctgggggacagagtgagaccctgtctcaaaaaaaaactctgcacattatttcctgaatacctattaccacacccaaatacctttagttgttgaatattacttttacccatatgcttacaagaaacttctgttacataatcaattaattacagcacaactctgtgaatccttgaaggacaggggccttaacttttttaactttgtatccccaactgcctaacatgaatcaagtcttattgaacatattttaagtgaaggacttactgctaaaatcacttttaaatggctctttaagtgataggcatttaaaataaatcattaatctaacaatggaagcatcataaattagttcatttttgatagaaaggacataactgggatgttatgtttcttaagacagtaccagtatttatctttcaaaatatgtacatttaaaaattgatctttttgctcaccgtaaaacttttaaaaattgggggaaataataaactaattatcagataaacaattcatttttctattatactttcctaggaacactaaaatgcttctgtgaaactttctagagtttgctcccctgacacttcaagttgccatggtagctactagcgacatgtggtttccaaacaagtgaaatgtaattagttcaaatcgaggtgtgcagtaagcataaaatgcacactggattccaaaatcttaacaggagaaaaagtatctcaaaatttgagatattactattttggattactgaattaaataaaatttactacaattattcccaatgtttccttttactcaaatttttaacatacccactagaaaaattacttatgttgctcacattgtatttatactgcacagcactgttatacacaacaaagttcgctctgcaacaagacaactgtcattgtcacaaaaatcactttttagactatgatgatttccaccaattccttactgataaccttgctgtgttctttgattactatggatcattggtaataaattagtcaaagaaaaacatccatgtaatacatacatctggtgcaaaaacacttaatatgccttatgtgaaacacaataatttttaaaagcactacacaaagaaatgaggttggttccaaccctcccagtcagggagaagatgtgtgggaatactgaaacaaccttttggaggtcatgtacaagattatcgatactactggatagctttggtgtcatgacagaaattaaatatgaatatttagacacacatgtctgtaagccagagacactaagtttaaagcaataatcaactaagaaatttttctttaaacagttgaaaaagcaaagacaggctataactaaagataatttaaaagggcagaggagtaaattccaggtctatttggattctaagatcaggctcttgactactaatcaaattgactcctcagcaaactttactactgatcaatgaaagtgatgagtatttgagtatacacaaaagtagacatgaaatgccaacagtggcataagatgaagctaaatgaagtaaagggagcaaggttcttatggcaggagaaaagtgagaggaaacaaaatgatcatctttagagaaggtcatttcctaaaagacagccgtaaaaagagaagagataaataaaaaagacaaaaacattgagcttaaattagaacagagcttatcacagatccttaaacctgatgaaactattacttaagaaaatccagacaacacataagaataaaagcattggtgaacagcaacaaaagtcaaaatagctgtcatacagtgtgaatttaagaaggaccaaatcagcattgctttctaatttccatcacaccctatcatctgccaattttcatcactggcaggacactgtgctgagtgatttgtctataaaagagaatctctgggaagaaaaaataaatcatggatgtcatccaaagaggctagaccgtatcattggcaggtagataagaaaggtcagaggactgacagaatttagggtaaaagaaaagcaacaggacttaatgtcaagaaatacaaagataaccaaagaaaagaggctggagttaaagcttaagtgaagtaaaaggaattaaagctaaatgatgagtaaatacattgaggaacagggggtgaattaggatatgtagcatttccatgtttaaaccttgcaaagacttctcattgcagaccgaatagaacccaaactccttcccttgcttacaaggcctacatgatctagcctttgttcgccttgatgatgtctctactacccacctagtaggctactatgctccaagtaaaatgacatgctgcctgttcatgaatcatgccaaatccattcctcaaggtctgtgtagtggtctgttccctctccctggaatgttctttcctcttatcttgcatgattggctttgtgccattcagttttcctattcaggaagtatatctggttgtatctactagatggatttttagggtaaaatttccagacaaggttaatgtatccttgtatcatcatgaaaataatgttgcaacaatgaccagccatttacctatgacagagcaccctaaaagtgtttcctgaagaaaatcttggccttcttcacagatactctctttagtgaatttctttataatgagatgcatgcttttgttaaatttctcaacttttataaaaagatgtcaaccttactcctaactcagtcaactatcacagctactgctctgccccttaggaagcaacagaaaatacatatactcaatatgtattatcattctcataacttaatccttagataggaggtaaaataactaccctttttaaagcaattaatacatacaaggcacaatgttatgtgaattccattcattgttttcatttaaccctcataataacactatgatttaagacagtatcattttaaaagcataaaaattaacttctgccatgacacacaattaggataggaaaaaatatttataaaacatgttaaaaaggtgacaaaacatcctatctgcaatattctttaaattatatccttggtacttaatccaagattatgatcgtcttaacagatgggtcagaacgctgtgtagttagaatgcactgcttaagatccccaaggaggccgggcacgatggctcacacctctgtatcccagcactttgggaggctgagacgggcagatcacgaggtcaggagttcgagacgaatctagccaacacagtgaaaccctgtctctactaaaaatacaaaaaattagccgggtgtgatggtatgcgcctgtaatcccagctacttgggaggctgaggcaggagaaatcgcatgaacctggaaggcggagtttgcagtgagccaaggccatgccactgcattccagccagagtgacagtgcgagactccatctcaaaaaaaaaaaaaaaaaaaaaaccccaaagaaatctaatttagtcatttaggccttgattttacaccaccgacttagtttgaaggctgctataagaaacagccctatgaaactgatatttttctactgcaaggtggctactttaagataatttttcattgcattgtatcaagtgatgtcttgttattattatatcattatatcaagtgacgtcttgttataaatagtaagaatcagattaagggctcatatttccttctttgtattgactgctgaaaaggtatggggccaaatttgtggttacgtctggagttatatatttttggggggggtctctctattaccttcatatttatcctatctaaattttccattgccaaatttccttactttagttttatcctattgctcatgtatttttatgagtctccataagtctattttggaaaaaggcagagtactcataattttagtgtatcttttagctttatgttgccataaacctttcattatatacatgatcaacaacagcatattatctcacctcagtatttattattttacaaactgatttatgattgctaacatgtaactgaaggtatacactgttagaacacagttttcagtagaaagtagcactgccattaagtaataaaatattctaacactacaacaacattcttgtaaaagtttgcatgttgtttgctgaggtctaaagcatgattaactacaaaaggctgaataaaattcagattcctatatacacacaaaattgttttattgagatgacaaagtatatttattatgccacccagaatataatccactctgataactgccagtttatgcacttgctgaagtaactcagtacataaatagtagccgtaacagttgcagtgcatgaagttcttctcttccagattgaagagtgtacaatctaacgcattttaaaactttaaatcccttattagcctaaatataatttaaaattctagtttgccttacctataatttgtacactaggttactaatggtgatatgattacatatgtggacacaaaataattttaatggaaaatgaaattatggtactcaacaaagaaaagggtaatgatcatgtagactaactgtatttgagattagtttaagcctggggtagctatacttacgtttcacagacctggagaagataggaaaaaagcttttattaacattgctaaggaacagataaaagctaacattaggtaactaagaggtgacataaaaaagattgaataaaatatcatggaggtttcataatgagattggaaattcaatagactaggagaaaaaagatcccaaaacatatatgctcatagggaaaacacatagtaagaaaaaggagagatctctatttaatgatacaatagtaaagagttataatttcctgtataatgtaaatttcacgcatttaaacattttcattgaattataaaatactatttggaaaagaaaaacagcacaactgcagattacagaagactaagatagatgaatcatgaaaaggtactagcagagatttctattatacctatcagggaaacacaatttctaagaatttcagaagtctttggtgttcttattaacgtaaatcctgaaataacacctgagtgaactgtcttctaattcttcaactggatggctttttagtgttgattgactttttaataaattattttatagtataaatcagaaatactgcatagtccctatttacatctttctacagtggtttttaaaatgttttaagaataaaaaccatgcaaactttatttgatttttctgaggaaataactttttggatttaatttcaatgaaaccactgataacatttccctccccagcgatccctggcaacgatccctcagattttaaagattatgtattattaccttttaatacaagtagaataacactcagggaatttacaacatttgttattttcagtaaatacattggttgaagtttaaaagtctatccgtagtaaacttacatctttcaggagcttggtcaatgtgttctggacaaagcaggaagatgtgactgaaatcctgaaaggtgccggctcctgcagcacaaggataatgatacatctgggtacatttctcttcacagcatttgatagtggctccaaggtgcttacaaaatgcacatcgctgaaaggggtaaaggagagaaatctctttataaaaccttgaaaaggaatattcaaatataagctgggaaggtataaaaaactctctgtatatcacaagtaaaacaaattgaacctgcaaaatattaaacaaaggattcgttaaaaataataaaatctacattactcaatttagcgcttcgtgtgctaccaactcatccttccattcaaattagaaagttagaatttcattccttatattttcaaaaataaattttgaagcatttttgaaacaaaacctaaagatttttttttaaagcaaatagtaatatggttaaaagggcaggtttctatattgaggattattataaagtttttaaatcccaccaaaactagtaataggaacatatattttatttatgagacatattactattttttaccctgcctaaaaataaatacaaaataaactcatcaattgtaagttaacagggacacaaatggttaaagactcacagaaaaaaacacaaaactacatacttcaatgtagcaatcaacttcaaatttcttaacaaaagatggaaatgtgggcgaaaaaaaattagtcatctggtatctttcccatttcaacctgcctccattatcttgcaagtggtaaaacgcacagaaataagccccaaacaagaggggcagtctagggcaagtgaacacataagaagtcagaagaaattatgtaaaatgttgcatttacttattcagttttcccttagaatgattcacaaactcttcctcattctcccaagtccactttgagcatcattttctttgaagagagtttgatgggccctgtactatacagtatgacatctctctgtgggaaatgactatctaacataaatttttgtttacaccattacatggtacttacttgcttatgccattacatgatcagtttatcttttcctcatcctagtccaagatccttcaattgaggcaccatactatctttgtatccaaagcaccaaaaatgctgcttgaaacaggccctaatagaaaggtgttcctatacatataccaaaaagacttaacttttggtgatcttttttgtgagtgtggctcataaacagcttagctgagataactggagcctcatgtaacacagacagttggaccctgctaacattactgtggatatcttcacatgttactacactgactttatattctgctaattaaccagggactacagtagttaaaattataattgttttcaatgttttatgtgtaaatctgtatatcacatactatcaaactcttcctcactgtcatcagtctactgcactgaatcaacataacaaagctaagtgactcctgagggctgaatcagaaagaagaaaagaaagagatacaaaaatttggctgggccgggtggctcacacctgtaatcccggcactttggaaggccaaggcgggtggatcacgaggtcaggagatcgagaccatcctggctaacacagtgaaactccatctctactaaaaatacaaaaaattagccagacgtggtggcgggcgcctgtagtcccagctacttgggaggctgaagcaggagaagcttctaaataactcataaacagtaattactgttgtgacactttaattttatataatattataagtatacagaataacatttcagtgctattttggcactcaagggtattaatgcattagaaacacagaaaataaatatttttcttcattgataaagtgtaataaccagcttttacaaaacaggtaattttttataactcccaaggtatctaaatatgtttagtgcattaacagaacccagaattaactacaaatacaacacctcggtagtctaaatgtctgaatagaaagaccacgtaaatgtcgaaaggaaaagtacaatcaatctgttgaaaaatgtttataacaactcattaacataactaatttctgctaaattgttaaaatctaaaatcgcttattttgataccatatggcaagttttgcagaagccttttacactaaaaataatcttggcagataaaatataatgagaggtaagtatataataacagaaagtaatttaaattgaccagcttctcaatgtctttctcattttagaaacaccaatatgttctcttaatcatatctgcaatgaaaaatattatattagctaaactactatgagaagtactggaatatatctaacatactaatttacaatatcatataaagatatcagtgaataaaagaaggaaaataaaacactacatttaggagaacgcttcaaacccatctgttacaattaaatagctaatgaagagcactcggcattaaaagaaaatgtttactatatatacacagtctggaatgtatcttcctaaaccaagtaaaaagtacttgtaaaatcgtagacaatatcaaagaatggatttccacagggaacttctcaaatgtcaacactcttatacactacacataaaagaaatcaagcaagttaaaatattaataatacaataagtaatatataatacataagtaacaattacgaagctaattaacatttggggaggagggataaagtaaacagctcttggccgggcatggtggctcatgcttttaatcccagcactttgggaggctgaggcaggtggatcatttgagctcaggagttagaaaccagcctgggcaacatggtgaaactccatctctacaaaaaatacaataattaggtgggcatggtggcatgcacctatagtcccagctactcacgagcctggggtgggaaaactgcttgagcccaggaggttgaggctgcagtgagctgtgatcacgctactgcactctagcctgggaaacaaaagtgagaaccagtctataaaattcaaaaaaaaaaaggcccttaaatggtgtatcaactaaatggtttatttgaatcaataatgaaaattcctagacagcattttttctttttacttttattcatcattaaaaagacagggagtaagaaaaggaaaaaagtaacatgttataataatattttcccatattaatccaagaacacaataacaacaacaacaaaaactcagtgagaactcgtattaccaattttaagaatgagtctgaggaattttcaagacttttatttaatagtttgaaataatctgtcaaaatgtatccataaaacaaaacagaatgaacaaaatttgagattaaagttgtatcataaaaaaataccaagaagttaaatattccacagttcatttaattaattatccagtatttattctgtaccaactatagcaatggttttaggctacgtgctctaataaataagtattataaggctccccatgctccaaatttgtttttaatcttcaccagtctttttttagtattaggcaactaggattctcccaggatgcagtaataaagaacaaagatggaaagtaagagaaagaggtagaatgacatgaaaatctgatccagaaggtgcaatgtctgttttatatgagtaccagaatgggagaaaatgggagggattataatcaccaaaattctaaaggaaaagttatgtaaatatctaataataaaagctaacatttaattaagcataatcctcattcaacagatgaggaacctaaaaccgaaagagtcattatcactgttccacttatttctatatccttacaaaaatacccactcttgatctgtaacaatgtctccttaaactccctgaatggcagcttcaggtaaaaacttcccagaaactttgaaataacaaggataaaaggaaaattcttggagccacataaaaaagaaaacagatcattacaaaaaaagaagaatcgggcatcagttctcattatcaatactgaattaaaaagaaacccaaaaaaaatcattatttttctaggcctataaaaaattatttaaaaccaaaattttaatgtctgttaagctaacattcaagtccatggataacaaatgtaaataggttaaattctctagtaaaagatagcaactttcaaaacatgcaaaatatactacataacacatatacatattttacatattactacagacttcatttatgtatgtgtgtgtgtgtacacatatataatatgaaataaatgaaatactttggatatttgtccccgccaaaatttcatgttgaaatgtaatccccaatgttggaggtggggccttatgggaggtgtttgggtcatgggggcaaatccctcatggcttggtgctgtccttgcgataacgagtgagttctcacaagatctggctgttcaaaagtgtatggcatctccacccctctcctttgctcctgttctggctatgtgagatgcctgctcccccttctccttcaaccatgatttcaaactttttttttttaatttatatttatttttttgagacagagtttcactctgttgcccaggctggagtgcagtggcctgatctcggctcactgcaacctctgccccgcaggttcaagcgattctcctgcctcagtctcccaagtagctgggattacaggcacctgccaccgcgcctggctaaatgatttcaaacttcttgaagccctcaccagaagcagatgccagcaccacacttcctgtactgtctgcagaatcgtgagccaattaaacctctttttgttatcaattacccagcaacaggtatttctttacagcaacacaggagcagctatatatatgcacaatgcacagtgacatacacaattcaaaaacagacttgaggggaaaaaacacaaacgctaaccaaaaaatgcaggtatagcaataattgcaaagaaatagaatttaaactaaaaagcagtgaacaagtcaaagataatatttcataataacctaagttttatgttacagtgtaaattccaaaagaagccatagtcattaaagtttatacacctaataaatatatgtcacatataaaaagtaaagctgagtagaaataacatgcatagattagactttaacatagctctcaaatcaggatattaagtagatatgaaataaataataacaatgatcgggtttgattcaaacagacacataaaatacacacagatctctgtattccaaaaatagagaaaacattctattcaaatatacatagaattttcaaaaaaaaatccacatgtatggtcgtaaagaaatgtccacatattttaaaaagcaggtatttcctaggttatattcagtaaaagcagatgtgtccctagacctaatacaataaaaattagaaattcacaatataaggataaagtcccaaatctatccactggcaaaatttaaaagtcctttctatataacggcagagtttcaatcaagaagaaaaatcatgtattatttttaaatgattaagaaacatcaaaaaaatctctgagacgtggcaaatgtggtcttcagaggaaaacatatagcttcaaacatgcaaaactataagactaaagaattaaaataaataatgcccaattcaaaaattaagccaataagaatcaacatataatccatgagattcacaatctagggaagtaaacccaccctaatactgtgtttattaaaatgctgttaatgagatccgaggtttaaacaactgttcactttagaaaatgaaataaagctgactgaaataaaacctaatctatgaaattattctgtatatgaattgacctgaagtaatgaacagttcattgactgactcataactcttgttctggtccaggctaatcattctagttggcatactattaaacacacatttctgattgaaacatctgctaaaaaaaataacatcaaacgacattacaaaatcaaaatggagactgctaagagtgggatttttctcctgccagtacctttcctttctgccacattctcctccctgctgccacagtaatctttctgaaggaatacaaatatattctgaatcacacgcaaacccctcaatacagaatgtgtggtaggcagtattctaaaatgcccgcataccaccgaccccaccaaatttcctaccctaatacagaggctgtaaatatgatgaaatatcatggcaaggataatgccattaatatattatatggcaaaggaattctgcagatgtgattaaagccaccaatcaactgcctttgaattaatcaaaagggagatttgcctaatctaatcaaataacctctttgaaagcggagttttctccagctagtagcaaaagggaaattcatagcaagggaacatttcaatacactgttgctatctttgaagataaaaagagccacgaggaaaaaccaaagagtggcctctaggaactgagagtgacccaagccaataggcagtaagaaaatggtgagctcagcagggtgcggtggctcatgcctgtaatcccagcactttggaaggccaaggcaggcggatcacgaggtcatgagatcaagaccatcctggctaacacggtaaaaccccgtctctactaaaaataaaaataaaaaaaaaaaattagccggcgtggtggcgcacgcctgtaatcccggccacctgggaggctgaggcacgagaatcacttgaacccgggaggcagaggttgcagtgagccgagactgcaccactgcactccagcctgggcggcagatcaagaaagaaagaaagaaaatggcgagctcagccctacaactgcatagaactgaattcctcccacacctgaatgcacctagaagaggattcacccccagagcttccacccaggtaacaccttgatttgaatcttgtgagaccttaaacagagagcacaggtgagcctaccctgagttctgacctaagtaaatggatgctgttttaagatattaagtttatggtaattgctttattgtaacagataacaaacagagcagcatttcaaggccctccatgctttggtctctgccaaatcactattacatttttaagatttttttttaaacattatacttacattacacaatgtcttaacactatgaagtaaaaatgtaaatattttaaactctggcttggaaatgaggaggcagaatctcagatattttcctaaaaaaataggagaggcaagctttctgagtccacaaaagtgccctctacctattgggtcaaagaaaaagtaatctctctatttgtaacaacatacataaattataaaccctgaagaaataggtccctaatagctataatctttaacataaccataaataaaaacatgaataaatctgactacatagaaatgtaaaaacttctatgtggtgagaacacacattacagaaaaaaaatcaagtgacaaaaaataacctccaatttgaattacaaatatctagtatcctggatatatacaaataaagcatgtaagttataaaaatgagtataattttaaaatagacaaggatagtttatagaatttcataatttaaggaagacataagttagccaataaactatgggtaatatgcaagaatcagtaagcattattatttgccagcagctaagccaagtactttataagaattactttattcccatctacgccaggcacagtggctcacgcatgtaatcccaacactttggaaggcagaggtaggtggatcacctgaggtcaggagtttgagaccatcctggccaacatggtgagaccccgtttctattaaaaatacaaaaattagctgggcctggtggcaggcgcctgtaatcccagctacttggaaggctgaggcaggagaatcagttgaacccaggaggtagaggttgcagtgagccaagatcgcgccactgcactccagcctgggcaacagagtgagactccatctcaaaaacaaaaacaaaaaaaaaaagaaattactttattcccatctaaccaccaccatttcaggtagatattactatttttcattttacaaatgaagcagagaggttaaatatccttgttcaagcccaatgagtcaggaaatgaaaggaactgaactcaaggagttcataattagttatatacaagtaataaagacaaattcatcgactatggaaatgtactaagtactttgtcttgtttacgtaatggtttttatttaggttgtaagaaaataacatatggacaggcacggtggctcgtgcatgtaatcccagcactttgggaggccaaggcaggcggatcacttgagaccaggagttcgagaccaacctggccaacatggtgaaaccccatttctaccaaaaaaaaaatacaaaaattagccaggcgtggtggtgcacgcctgtaatcctagctactcgagagactgaggcaggagaatcgcttgaacccaagaggtggaggctgcagtgagccaagattgcgccactgcactccagcctgggtgacagagctggaccttgtctcaaaaaaaaaaaaaagaaagaaagaaaagaaagtagccactttggggttagaatccataaaatactctcagtgtcaaccaaaagaaatgtactgcaatgttcatagaacacaattcataatgacctcaaattgaaagtcctcaaaatgcccaacggtaaaataaataaattatagtactcttaacaacagaatactatacatcaatgagaaaaataaacgactggaaggaacaatttggatttatctcacaaatatatacatgaaagatgacagaaaacagtacttagtagccaattatacaaagtacaaagccaattacacaaagtacaaacataggcaagactcacctatgttgttactagatgatagtgcatgtctttggggagttaggaatagtaaccaacaggaggctgaatggaatttctggggcgctattatttgtttcctgatgtgattttagtatatacgttctaatatttggggtattcctagaaatgtgtacctattattcacttgctatatatatagcaaagtgaattttatatataattcttcaacatatttttagaaaaattaagttttttctagaaaattaagagaattttagataaaaactcaacttttaatggaaaatattttcctttttctttctcacatgaaattctatatcaaggttagtatcctacctggtatctctccaatagtgggttaagagtttgttttcttctcaagtaacctgtattatattaagatgatattaactgaaataatcagatagatgaatgcgccataaagctaattctaagatatctgtccttagccaaaagcagaaaagggatacacataacttccacataaaacatccacccccatttttttggttattcttaaaagctcataatgtatacaatgataaaatttattgtttcaaattagggtttttgaaattgaaatattaatttaaacacgtttgcttaacacaactttaaagttaataagaaaacactgcctattacagaagagttaaatacttcaaaaagtgggaaaaaatttaaaagctttcattttagtaggagtaaacacagacacagtaagaatcaagttagttggatacacttaaatcatgtcttttaagaacatgagaacagattatttgctttctctttagtccaaaacctgggtgtaattttagtccaaatttgaaactaacagaagaatactcagcttcttaaaagttttatttcaagaacagtaaaagaacttctggtcttacaaacattacacagataaaacgagtttctccaaacagatgtatgtaaaaatctagtacatatacccccaaggtgagtcaataaggtgaaccagattctggttgaatggaatccttgaaacataactttggtgaacaaactgtttgtgttttccacttttcttaaaaaagaagtgataaagcagatttccagtacctgccaactgataaaatgctacttaccaggtaaaaaccactaccaaaaatcagaatcacagaagggctatcagtaaaattactaatgccacaaattaacatgatgttaactgctgaattatgcatcaaaagagtatttatataatcacagcaaataactcaaatcttttacatcactagtaaactcaaaaaaagatagaaaaaagcaataacattaaatttccttattgatctactagctttaactatttaatactagtacacttagttttgattactttgaaattgaaacaaaaacaataatcttttcttcttttaatgactttttcagttataggaaagatgatattaaaagaaaatatacaactatagcttagctacaggtataaaactgttttaaagatatgtaattgtgctattgaattaaactgaaaacataaatatcaactcatgattttgaaaaaaaatctttatgtttggttttggtaaaaggagagacaaataagtcagaaaaacagaaaatacagaaatagactcacttttccatattcaattaatttttgaccaaggggccaagataatccaagagagcaataaatagtcttttagaatgatgctggaactgctaaataatccgtatggaaaacaaagaaacatgaatcttatctcaaattcttttatcatatgtgtaatttaaccataaatggattttttaaacctacaactaacactggggcaagcaaagattttttaataaagcataaacagcataattttttcaacttccaaaaaattaacaaatgaccaatgtcatcaaaattaaaccctctgctgttcaataaacattgctaaataaatgaaaacaagtcacacattaggcaaaaatatttataaaatgcatctccaaaactgacttctgtgaataatatataaaaaaactcttacaactcaagaagatgacaagtaaatcaattggaaaaaaatggtagagacaaaataacagacatgtcaccaaagatacacaaatggcaaaaaaagacataaaaagaggctcaatctaattaatcatcagggaatgcaaaatcaaacccacaataaattatcactaaatgccaaccagatggctaaaatttagaaacagtggcaatatccagtgctggcaacaatgtacagcaaatggaactctcagatctctagaaacggagaagtatacagacacttaagaaactgtgaaactgttttccaaagttaagaatatatttccaacaagtcagaaattccagtcctaggtatttacccaagaaacatgaaaagatacatccacaacgaagcatgttacataaatgctcacagcagctttatatactggccaaaaattgaacgaaacttaactgtaagctagtgaatggaccaatctcaaaaccattatgctaagtaaaaaaaggcagacagaaaagattctatactgtatggttccattcatatattagtctagaaaaggcaaaactataggaaagcaacagatcggtgattggcaggagctggagtgggaggtaggcagtaacttcaaaaggtcatgagtgaatttatgggtaaagggtctattctgtatcttgactatgatggtaattacatgactgttcatatttaccaaatcacattcaatacacaccttagaaagggtgaattatagcgtatgcaaaatataccttaacaaaacaatggctctcacacataaatttatttatttattgggtaacagcatagggactaatatcagagtaactttcctaaaatgtctcaaatctgaagaaaacgtaaaagctaactaattgaagttacctgtaaataaccaaaaactggctggaatgggaggacattatacccttggaaaaaaagcagaatatcattggctaaaatctatatttaaatagagtttcagtctgggcgcgatggctcctgcctgtaatcccagcactctggaaggccaaggaaggtggaccacctaaggccaggattttgagagcagcctagccaacatggcgaaaccccatctctactaaaaatacaaaaattagctgggtgtggtggtgggcacctataatcccagctacttgagaggctgaggcacaagaatcgcttgaacctgggaggtggaggtggctgtaagccgagatcgcgccattgcactccagcctgggagacaaagaccctgtctcaaaagaaaagaaaagaaaattctacaactaataagtatggtaatttcaatgaaaattttagtggatgggcttaacaagagattggtagaaaattggtccatctccttgaaaatacatgaatagtgtatctattctgaggaactaaaagtaaaaacactgggaagaaaacgaacagaccctcagtaatctacaaaatatcaaatatactaacattcatgtaattagagttacagaggaagaggagagagaaatgagacagaaaaagaataagaaataaaagtcaagcttttcacaaatttggtgaaaaatatcaacttacagtttcaagaagctcagcaacccccaagcaggatgaatacaaagaaaaccacacctaggcacatcatagtcagactgctgaaaaccaaagataaagagaaaatcctgaaagcagccagagaatatcaaaacattattatatacatgggaataatgatactactgacaccacacctgacttctcattagaaaccatggaagacaggaaacaatgcaacatcttttaaatgcttgaagaagaaaaacataatcatcccagaactctgtattcagggaaaaacagcaaaaatgaatgcagacttccacttccagacaaaatgcagaaaatgtacttttccctgttctttccactaaatacagctttaaaaacccttagccgtgatacataagacaaacaaaagaagacaacaaaatgtagagagagggcagaccaattagggcttcaggagccaagaaacaaaagaggatgaattccctaggtttcctttctgactcatatatacaagaaaagttgctagagaagcagacaactcagaaacaccaacaggcacacacatacgtaaaactccaagaaaattctgctgtcttttgtcaaaaaagcagggaagcggcaggctaccaagacaaaaaactcatagacaacaacaaaccagtttaagccaaatggtacaaataaaagcccaagccatataccttttgcaaagacttaaaaggaggacatagtcagccattccccactcctgcccacggacaacatgataccacagcaggccaactgggacacaggacattcatacccactgagcagtaacgcggcttcctccctctagagtgtgggtggaaaaaaagtggggagcctgagttcaacacccacccagtgataaggacatatccctatccctccctctacagagatatgacaggagaggcctattggagaatccaaactcaaagcactgcccagtgataacttaaccacccctccatcccattcagtggaggccaagtgaaaagcaggaaccttttgagccagggtggtattcacaaaggtgtaatgcaagtccagagttttcactcctactcagcatttactaggtgtacgtctccatcaatgagtcaacaaaggcctactaaggaactggaatcttcacatacacctgggagtagtaacaaggctgtgccccacctccaccccaaaagcaaagtttcagataaatcctactaaaagggggtatttaaataaaatgcagagcttcataacacaacacttaaaatgcaaaggattcaaccaaatataacatgttataccatactaagaaccaggaaaatctgaacaggaatttgaaaatatagtcaaaaggtgcaaacaatgagaattcatagatgtcataattatctatcaaagattttaaactatataacactgcttcaacaagcaattacagccggacacagtggctcacgcctgcaatcccagcactttgggaggcagaggtggttggatcacttgaggtcaggagttcgagaccagcctggccaacatcatgaaaccccatctctactaaaaatacaaaaattagccaggcatggtggtgcacgcctgtgattccagctactcaggaggctgaggcatgagaatcacttaaacccaggaagcagaggttgcagtgagctgagatcatttactgcattccaacctgggcaacagagcaagagtctgcctcaaaaaaaaaaaaaaaaaaaaaaagcaattacaaacatacttttgaaacaaaggaaacaatacaaagttttgcaaagaaatcaagaaagaaacaaataccaagttgaaaactaaaaaatatgctaacaaaaataaaatacaaactaagctgaacaacaaaatgggagagattacccaacctaaacaagagaagaaaatgaactgatttaaaaaaaaaaaaaaaaaaaagtggccaggtgcggtcgctcaggcctgtaatcctagcattttgggaggccgagatgggtggatcacctgaggtgaggagttcaagaccagcctggccaacatggcaaaaccctgtctctactaaaaatacaaaaattagctgggcatggtggcacacacctataattccagcgactcaggaggctgaggcaggagaatcacttagacccaggggcggagtttgcagtgagctgagatcgtaccacttcactccagcctgggcaaaagagcaaaactctgacaataaataaataaataaataaatattttttttttaaaaaagacattaaagacacttgtgggactataataagtgatgcaacattcctgtcactggaatctcagaaaaggaacatgacgcagctgaacaattattcgaagacccacagattcaagaaattgaataaatcctaagaggatacacacaaataaatcaatgctaatatatatcataaacttctgaaaactaatgactaaactaaaaaaccctgagataaataagagaaatgacaccttatccacagatgaaaaacaactcaaatgacagcagatttctcacctgaaaccatggaggccagaacaaagcagcataacatttttgcaagtcctaaaagaactgacaacaaagaattctatatccagcaaaaacatccattagtaatgaaagggaaatcaagaaattgtgagatgaatgagaactaaaaattagtcatgagacaaaactacaccaaaagaatagtgagaaaagttattgaaccagaaaggagaatgataaaaagaaggattctcagaacatcctgaaggaagaaagaacaaacaaatagtaaaaatatgggcaataaaacagactttactgttccttgagttttcaaaataatgtttaacaattgaagcaaaaattgttacacgatgcaaaagctatggtgggtaaaactgttgatgcatttccaaaactgaaagcagttggcaccaagctgtattagaagttgtcacattctcaattggcactacaactacagtaaaaataatgtagagtatcattgagaatatcactgatgaagcagcaaaaatcattaatgttttaagtcttgatccatgaatacacatcttttaattatctatgtgacaaaacgagaaataaagagtaaaataattgttacaccatagtttttcttgaggaaagaatttgtgatcatgtgatttataaactgaaataaatgcttttttcatggaacaccggttttacatgtaagaacaaataacaaaccacaattattaaaacttgattatctaacatatttcttgaaaaaaggaataaagtgagcctgtcacttcaaggaaaacaacttagaacatgagtggacaataagaagatttgaaaaacttatatccaacaatgtaagcttaactaattccaatacttaaagacttttctgatgagatcagtggattataacaaatgtgaattttgttatttattaaaaatgtgtaggactaggcaaggtggctcacacttgtaatcccagcactttgggatcactggaggccaggagttcaagaccagcctagccaacatagtgaaaccccatctctactaaaaatatgaaaattagctgggcctggcggtgcatgcctatagtcccagctactcaggaggctgaggcatgagcatcacttgaacccaggagacagaagtgagctgagatcgcaccactgcattccagcctgggcaacagagtgagattctgtctcaaaacaaacaaaacaaaacaaacaaacaaacaaacaaaaacaaccgtatcaatagttggaatatctggatcactcagtgaaccaatattttccaaagaccacttagtaatcttataaaatcatatatgggtaaaagatcccctgaaattgcaaggtagtctaataaattttatatatatatgtgtgtgtgtgtgtgtgtgtgtgtgtgtgtgtatgtgtatatatatatatatatatatatatatatatatatattttttttttttttttttttttttttttttgtctgagatggagtctcactctgtcacccacgctggagtgcagtggcacaatctcggctcactgcaacctccaccacctgggtttaagcgattctctgtctcggcctcccccgtagatgggactgcaggtgcctgctaccatgcccggctgatttttgtatttttagtagagacggggtttcacaatcttggccatgctggtcttgagctcctgacctcgtgatccacccgcttcagcctcccgaagtgctgggattacaggcgtaaaccactgcgcccggcccataaattataattttaaagggtaaagatataaagttcattgatgggattgcagtcttcagattgcaccaaaccacttgaaaaacttgcgaaactaccacttctcaagctttggtttagtatcaaacaagaatattcattagggcttgtgctttcattcttatagtatcttttaataaacagaagttatttctcaaatgtagttgaatgctccaatattttcctttacattcagtgctgtatctcaagaactcttttacaaaaatattatcctatattatctttttaaatataaataaaaataattatctttttaaaagcttatgagttcaggtagaaatatgaagggctaaaaggaattggaagacattttcctactatttgttctttctcttgattttcatgattcattattcttgtagaagtgaccttaccacagtataaggttcacttataatcactgttctgccttgtaattttaggtgaatttgttacaaaatattatgaaatctacaggaaaagccaactttcaaagctattaagtatttgacttaatagttgagggcattattattcagaaaaatttcaatctcattccgcagcgcaaaaaactgcaataaaactttaccactgccaagtcactaaattgctatgtagaatggcaattcagtatattctgcctctatatctaacaaaaattcataggatttgatgatgaagtccacaaatgcaagtcaaaatcactgctgacactattatataatagttcactaaaacatgacagatttaaatattttctgcaaagtacctgctaataaataatacagtaaataatcaggctttaaacacctgacatttaacaagctttgtaaatttgtccaactcaagtctttctgctccacagttatttttgccactatcaactgtaacgcatcttagcggattccacttcaggttgtactaagttagtgtttgctcaacttttctgaaaatattttctcttgtagttgtttcacatagactatgcataaacactaattcttccatcacttcaaactcagcactaacttctggagtatgtaacaactgaacagtactggtaacacctattcatccatcaaaagcctaagaaaaccatgaaaaatcattcacccttctttccaaaatgacttgatattactcccaacgtccttaacttttagagcaattactctcgctgaaaggctaatagtcttttttaaagtttattttctatggacacatctttgtttaccttaataaaacataatttaattaactactgttggtaatggttttccttgcttggctaacaaataagccattgaaaaacttactttaattatagcctaatttccattttttgtttttgagaagaaattctgctgtgataaaattttgttttaatttactatttttttttctgaccttttagttttattcctgttggctgggaatattgtgagaagtgccaagtctggtaatgctgacatatattatattcttttagcacagccatagtcttctagcataataaatataatgctttgctatctaatttgttaataataatatacattccactatacctctaaagtgttacatataaagtccacttttctccttttcttgttttaacatgataggtgggtatgcactggtaatgagagaaataaataagatgccagggcaatatgtgtggcgcgcacacacacacacacatactgacaaactgtaactatgtcattgtgattcgtagcatgcagagcagcaatttgaaatatatgtgctctctgcagcaaccaactctgacactgtagtgcaacagaagtcatatataatgcccaaataaatgggtgtggttttgttcccataaaacattagttttaaacactcatacctgaatgtcgttatgatttcctgtgtcataaaatattattcccttttaaatttttttcagacattttaaaaggtaaaaaacatttttagctcatgtcccacataaacacagctggaggaccgaatgtgaccccacaggctgtcatttgctgacacctccatccacccctctgtagccttcagggtcctaaataaacttctatagcatttaatgacccctaaattccctttttgtcttcccagctctgcagactgccagaagcttctcagcttttcaacctctcagctggatttttttgaactgagtaattaactcaaggggaaaagaaaatttaaggtcaggccaaactctgcacaaccttaccctctgaattctcactccctcaggtcctcaccactcttctagttttctgatcccttaaatatttatttgaaacaacattttatacagcttttctaattgttctcagtggaaaggctagtctaaaccaagtatctctgccataggaagaggtggaaataacacttatactaccgaatagaaagacttagtataaagctacagtaacaatgacatcatgatatatcactgggattctcaaatacacaaagaataaaacagagaacctaccaacaatctaaaatacattgaacgtttgctatataataggttatatttcaaatgtggaggaaaaagatgtttcaataaatggtgtagtaacaattggctgtccatgtgtgaaaaaatgatactggaccccttatatcacatgatacacaaatcaatttcaaatagataaaacacacaatagtgcacaactagagaaataagtttttgaagtatattttcaaaacaagttagaaactgttaaaaggtttttaatttttgaaataaaaacattaccatggttcaaaagttcctaaagggtatgcagtataaaatcactttgtatacaactatataaaataagtttcctacaggcaaagaattttaccagtttcctatgcatccttcacaagatattttatgcagatgtaagttcatattattctccacccctcccctaaactttacattcaaggggtcctttacaataccaaagaataccacccacctcatcacaaaggtaagttcatttctttaaacttatttaatactaaaaagaaagattaaaattaaattgagacatcttcattgaatgggcctaccaaaatttaactgtttttaaataggcatacaaaactcttaattttctaaaacaaatttttcagcttcctcttagctccagagtcaaggtgtcaaggtgacgggaaataaacatattcattcattccctcattcattcatttttgagacaaagtctggctctgttgcccaggctggagtgcagtggtgcaatctcagctgactgcaacctctgcatcctgggctcaagccatccctcccacctcaacctcttgagtagctgagactacaggtgtgcaccaccacacctgcctttttttttttttttttggtacttttagtgaaaagacagggtcttgtcacattgcccaggctggtctcgaacttgtagctcaagttatgtgcctgcctcagcctcccaaagtgctgggattacaggtgtgagccactatgcccagccacatcaatttttaagtagatatatgcctaacggcattccaaggtcaaataaatatctaggattatcttgctgtaccgacaccttgcacttaacattgtgatgaaataatccattgttaattttttgatgccttccttctatccctgcatttcagagtgaaaagataaaacaatttcttactgtgtacatgatgattgagtactgacaggtaacatgacctggggaagaagtcacttgacattagctaacaatgtcagagacagattaagaagtgaagactcccgattgcttcccattaaaaataataattatgaccaggtatggtgacatgtacctgtagtcccagctatgtgggaggctgagctggaaacattgctagagttcatagttgcagtatactatcattacatgtgtgaatagccactgcactccagcatgagcaacacagcaagatccctctctgccggacccgccactcccaaaatagaagactctatctcttaaaaaataaatattattaggttttatttagaaacttttatttagaaaatcttataatacaaaaacacacttgagaggcatttgagattattgaccatacctccttaaatctattaatccaaactactataatttctactatacttcctgtaacttattctgtgttaacatccaccttttcactggttcttcctcagagcattgaccaaaggatcaatcttccatcttcttttctcttcttgttctccaaagtcagtttgatttgccaccactgctagttaggaaaactgtctatgattcctaccctgacatttagtgtcaaagccatttcacacggtttcaggctcagcacaaccaaacaaaacttgtgatcttccaacatacttagacttgaaaaaaaagacatctgcagttcctccatctaatttataaagaatcaaatactatgcattctattacaatatttcatctttatgttttacacataatacctaaactcaagattttacactcattggcctttaatttatagcagtaatcctaaatatgtttgtcttcaagtaaaccttttccaattcaattacaaagggctgggggaatttagatcatttaatactgctcttcttatttaaaaggtacattactgaaattcctcatcttggtatgcaaagccaaggaaattttccattcctgtcccctagtattctctaccctacttattctccagtcattcttacgtatgtgccatttttccaaaatccatataccctcatagtttcaaaccctgtaaagggtgaccctctgtctagaatccctatgttaatctactgaaacttacccatcctccaagcaccaccttaaatctttccttctttaaaaatattttcagattccctcagttaaaacatatttccaataatagacactgtttattgcctataaaatatccattccccctttttccttcctacagatttccactttttcagatacgcaccctgctctaagcagaaacatgcttcagaggggctaaatactctccccagcctcagaggaaagccatcatggctgtctcaacttctttatcagttattggtttaagatatgaacgctcggctgggcgcagtggctcacgcctgtaatcccagcactttgggaggccgaggcgggcagatcacgaggtcaggagatcgagaccatcctagctaacacggtgaaaccccgtctctactaaaaatacaaaaaaaattagccgggcatggtggcgggtgcctatagtcccagctactcgggaggctgaggcaggagaatggcgtgaacccaggagacagagctggcagtgagccgagatcacgccactgcactccagcttgggcaacagaacgagactccgtctcaaaaaaaaaaaaaaaaaaaaaaagatatgaacactcaaggtaattctagctaataaaatgttaagaggaatatgccaggggcagggcgtggtggctcacgcttataatcctagcactttgggaggctgaggcgggcgggtcacctgaggtcaggagttcaagactagcctgggcaacatggcgaaaccccatcccatccctactaaaaatacaaaaattaaccgggcgtggtggtgggtgcctataatcccagctactccagaggctgaggcaagagaatcacttgaacctgggagacagaggttgcagtgagccgagatcgcgccacttcaatccagcctgggcgaaaggcgaaactccatctcaaaaaaaaaaaaaagagagagagagagagagagaaatatgctaggatgggacaagcatctggcaaggatttttccttaattaacataataataaaaaggttcctttttcctttctgcctctgaatgctatcctgagagtacaatgcttagaggtcctgcccactatcttttgctcatgagaggaactggatcaagaaagagaccaatatgttctggatgcaccaagaaaagatgttaagaccctgacaacttgttatcatgaagctactgaactacccatcaccctaactcctaattttctattgtgaaataataaacttcttagttacttgcataatacttctaattctgaccaagatggagtcacagagaccggattatcggatttacgctcctcctgaaacaaccataaaaaatgaagacatggcagggcatggtggctcacacctgtaatcccagcactttcagaggctaagacaggtgcgtcacttgaggtcaggagtttgagaccagcctgacaaacatggtgaaatcccatcaccactaaaaagaaagaaagaaagaaaaagaaagaaagaaagaaagaaagaaagaaagaaagaaagaaagaaagaaagaaagacagagagagagagagagagagagagagagagagagagagaaagaaagaaagacgtgaatatatgtgaacatatatatgctatgtgaacatcaggcaacaaaggactgtagagctttgagaaatgagaaacaaaagaggtgagccctacatatgccccagcacacaacgataagagtttccaggccatggcatagagagtggcaactgaggcaaatctcagctgactcctgagttggaaagagaaagttaagagccaggagagaaaaaagcagcaaggaataactgcacagaatgctgagaggagacagttgcatagaaaagaaccccagaggtctatagagatcttctctcaagcattcaccagataactgatcagcatatgcatatgaggaaactatgagaatccagaaaaagaaccatcagaaacaatgggagggaacagggcctgatactcatacaaagccaggaatagtatctgttcccactagccaaactgggaaaactattaattcatggaacattcaacagagtccacagaaagtcttgcctcagtggtgaggaataattagtcctggactaagcactccttcatatctgtctaataaatcataaaaacaaaacccaaaagaatgaaacggtttataagtaactcaactacatctcaaaacaaagctcaagaagatttatagaataaagaaaatagccagaacccaaggtaaattttacaactaaataaagattaccaggcataaaaagcagcagacaatcatgatgcaaactgaaaataatcaatcaaaactgacccagaacttaaatagatgttaaaattagcagaggaggacattcaactgtttttatacatgtatcccatataatcaaaaagttaaatagagacatgggagataaacaagaaaagccaaaatcaaactttcaaagacaaaaacatttgagatgaaaattacattggatgaactaaagcagattagaaactgcagaagaaaagattagcaaacttgaagatacaagaacagacactagctaaagtacaaaaagaaaaaaaaaatcttaaaaagtgatttttaaaaagcatcagtgagcagtcaggcaacttcaaatagcctaataatatgcaggtaactggagtccccaaaggagaaaaaagaggaagagaaaaaaaatacttgaagaaacaactgctgaaaatgttctagccataaaaagacctattaactcacggatccaagaaactcagcaaaccccaagcacaagaaacatgaagaaaattacattaagggataacataatcaaattgttcaaaatcagggatatattattaatagcagctgtataaaaagacatgttacctatagaagaacaaagataagaacaacatcagatttcttttgagaaacaatgcaagtgagaagacagcagtacatctctaaagttctagaagaaaaaaggccaactagaattccatgcctggcaaaaatatctttcaaaaatgaaggtgaaataaaggcacaccagaaacataaataatgaaataattcatcaccaggagactttcactgcaagaaatgttaaaggatattctccagaaacaaaatgatgtcagatgaaaatctggatcaatacgaaggaataaagagcaccacagtggtaactatatgagcaaacatcttttaaattttttattatttaaatctctaagagatatatgtttaataaaagacagcaaaatattacagagtttataacatatataaaagtcaaatgcatggcagcaatagcacaaagtgcacgagggaggaaaagaaagcaaatgaaggaatgcttttattatagatgaagtgtacaatattacttgaaggtagacctctctaaatgtacactataatcttaaagcaactacaaaaataatttttaaaaacaggtaaaagtaataaaaagaggcaaactggaatcataataaataatgtaggctgggcacggtggctcacgcctgtaatcccagcactttgggaggccaaggtaagcggatcacaaggtcaggagatcgagaccatcctggccaacatggtgaaaccccgtctctactaaaaatacaaaaattagctgggtgtggtggtgcacgtctgtaatcccagctactcaggagactgaggcaggagaatcgcttgaacccaggaggcggagactacagtgagccgagatagcgccactgcactccagcctggcaacagagcgagactctatctcaaaaaataaataaataaataaataaataaataaataaagtaaaagaatccaagaagaccaggtgcaatggctcacacctgtaatcccagcactctgggtggccaaggcaggagactcacttgagctcaggagtatgagaccagcctggacaacatagtgagaccccatatataaaaaaataaaacaaagtagccaggtgtggtggtgcacaactgtggtctccactattgggaggctgaggtagatcacttgagcctagcaggtcaaggctgcagtaaggtatgatcacaccactgcactctagcttgggtgacagagtaagaccccatcttggcaggtgggggatgcaagaaaaatgatgcaaggaacagatagagataaatagaaaacatataagaagacaatcacattaaatgtacatggtctaaatacccccaattaaaaagcagaggttttagaccatatacatttaatgtgattgtcttcttatatgtttttatcagagaaataaaactatcgccttcaagaaacacaagttaaatacaaagatgcaaacaggttaaaataaaagaatggaataatatacaccatgcttacgctagtcaagagaaagctagagtagaaatactaatatgaggcaaagcatatttcagagttaaacacaacatttttctactacttgcagtcaaaagtatcattaacagtctctttactctgctcaaagttacaaagttcttttgtataaacattagaacacttatcacagcctgtctataatggagaataattcaatgttatatactatacaacactcttactatagtccattagacagaaatatgtagcatttgagacaccttccaattataaaactctatgcaaacaaaaattaacaaagcagatctgagactattacattatcctgtgaaggagggtctgtctgtttgcacagttggtcctaggctggcttctgagaacttgaatttcaagagggttccctaactggtaatcatggtttactatatctagactatggaaataatgtggcttatcctgctattctttttatgagtctggaaatttcacacatgctaggcagagagtacacctacatgaccagcctagataaaaactgtgtttcttgggcagtcacatatgttgttgtattttcgttaagggggaaagaaggtagtctgtgtgatcctcatggaaggcacagcacataaggaagctggtacatggatttttccagactctgtcagtgtcttttgccattgaggtctttctactatatatccatactatgttacagtaataaatcttagccattacaaccctaagctgatcccatgagtccttctagcaaatctccaaacatggaggcagtcttgtggacccctgacacaaatatatggttgtgatctcttaaggtttatccttcctcttaaactataaagagctggccgggcacagtggctcacgcttgtaatgccagcactttgggaggctgaggcgggtggatcacgaggtcaagagattgagaccatcctagccaacatggcgaaaccccgtctctactaaaactacaaaaagtagctgggcatgctggcacacatctgtagtcccagctactcgggaggctgaggcaggagagtcgcttgaaccagggaggcagaggttgcagtaagccgagatcgcgccactgcactccagcctggtgacagagggaaacttcatctcaaaaaaaagaaaaaaactataaagggctgggcgcagtggctcacgcctataatactagcaccttggcaggcccaggtgggagaactgcttgggcccaggaattgagaccaacctggaaaacagagcaagaccctgtctcctaaaaaaaaaaaaaaaaagaaaagttggccgggtgtgatggatcacacctgtagtcccaacactttgggaggccgaagtgggcaaatcacaaggtcaggagttcgagaccagcctggcccacacggtgaaactccatctctactaaaaaaaaaatacaaaatattcgctgggcatggtggtgggcacctgtaatcccagctacttggaaggctgaggcaggagaatcacttgaacccgggaggcagaggttgcagtgagccgagatcatgccactgcattccagcccgctgacagtgtgagactccatctcaaaaaaataaaaaagaaaagaaaagaaaagttagccaggtgtggtggcatgcatttgtgatcccagctactctaaaggctgagacgggaggactgcttgagcctaagaagtcaaggttgcagtaagccatgatcgtgccactgcattccagcttaaacaactgagatgctatctcttaaaaacagaagtagaagcaaacaactataggggaaaatgagggatacatactttaagaatttctaaaaatttacatggaaaaacactaggattctatagaaaataaaacagtattaaataacattatttataaaatagatactagcaaattaccttacgtaaagattcaagtcagtaacttaaaggatcttacataaaagtactttccattggttggaggagagacttttactatacactgtttttcaacttttttagacaaattacatttagaagtttaaatttgcctatctacattcttaatgtgaattgccaccttactataggaaggctatttttgtttctgcagtctacaaaaagaacaaaaatattaaaaacgtacaactcttctcacagaactaagttggttttacacaaagacatctggcacaaaatacaatgaaatttcaatatagaattacagcaggggatgagggtggagaaggaagagattaccaattctatgaggggagacaacagaagtatttttttaatgtcttattttaagagtaaaacacctggttttttttgagatggagttttaggcaggagtgcaatagaacgatcttggctcactgcaatctctgcctccaggattcaagtgattctcctgcctcagcctctcgagtagctgggattacaggcacacgtcaccatgccaagctaatttttgtatttttagtagagagggggtttcatcacattggccaggctggtttcaaactcctgacctcagcctcagcctcccaaagtgctaggattacaggcgtgagccaccatgcccagccaacactgaacattttattcagaaatagttaagaaaacagaaatatacattgggggtttatggattacttctttttggggggcaatactgggaatagaagagaaaggagcttcctttccctttccttctttcattcattcattcattttgagaagaagtcctgctctgttgcccaggatggagtgcagtggcgaaaactcagctcactacaacctccacctcctgggttcaagaaattctcctgcctcagcctcccaagtagctgagattacaggcacacaccaccacacacggttaatttttatatttttttagtagagacagggttttgccatgttggttaggctggtctcgaactcctgacctcaggtgatccacccgcctcagcctcccaaagtgctgggattacaggcatgagacgccgcgcctggccaagaaaggaactttagataaataaaatgattaaacatttgtagcatgtagaatgaaaatattccctcagtaatactcaaattatccagatttccaagatgttggtagcaccctgagagcttcaaaagggaaattaaaagaaaaacgacgttacccttcctgaaacacagattcactgtttgccatgttcttttctctagtaaaaaatgaataaagtttcccctggaaaaactaaaaacaatctgaggtatgtttcagagaaaacaaaattgcttgacaaaaatgccatgttaacaaccgaggaaattactttaaatatattaattttaacacaggaataatatgtcaaaccaggatttctcaacctcagcactatcggcattttaagctgtatagttttggtgtgggaggctgtcctgcatattgcagaatgtttagcggcagtcctggcctctacccaagaggccagccagtaggacctacctcctcattcaagctaatgcactaaattttgcccttcattgacaaatcccattaatgcatgtatttatcccattagtgactctcttgtgttccagatactttgttaggcaccagagaaaatatgataaagcaaaacagctattttcctcactctcatggtgcttacagccatggtgggaaaaatccatagaaaaagactcacatacacaaatgcagacagaataaaaaactcacacaaacaaacgctgcagatgttaagttacataaaggagatatgcatggctgtgcatggtggctcatgcctgtaatcttagcacttggggaggccaaggcaggcggatcacctgaggccaggagttcaagaccagcctggccaacatggcgaaaccctgtctctactaaaaatacaaaaattagccaggcgtggtggtccacgcctatgatctcagctacctgggagactgaggtgggaggatgacttgggcccaggaagcagaaggtgcagtaaactgagattgcgccactgcaatctcagcctaggagacagagagagactatgtctccaaaaacaaaaaaaaagagagagaagacatacatattccactgagaatgtataataaagctgcatactcaaacatttcttattaaaagatgtgcacaatcaaaaaatttacaaaatactgcaacccctcacctgagctttatagtatctcattcccttccattttcttagattaaaaagcctaattctaactttggtttattttaatacctagtttctatggctctcataggtttaaaaaaacaggttctccccaaaagtaaaatgatctaattagaagtagtacatgatttctgcaaccatttttaaatctcaaccgaaattatcaaaatttaagcaaataaaatttcaccctctctaataaaaatattgaatgtttaataaatgggcttaaaccagagctctttagaatattttaaacatatcagaaaattccatgttcaagtttcttttaaggtgacaaacatgagagttttttgttttgtttttacaaccttcattatttctgacaataaaatatcaatataaatagttcaaaacatctgttttcaaaatgttcaacgccccaggacatgtttctttgaaaagtcactgcattctcaatgttgaaatgtcatctttatcttgaaggggcaggttaagtgtttgttttctttgaaaatagagctaggtatcagaatatactcagctacataataaaggtcagcaaatttcatttttcattttttattttaatagagacgagatctcactatgttgctcaggctggtctcaaactcctgggctcaagaaatcctcccatcttggcctcccaacatgctagaattacaggtgggaggcactgcacctagccaaggtcagcaaaatcgaccttttggcaaaataaaaacgtcttctaagttcaatagctatatcgcccctagggaaacttttgtgatagcagaaattttccttggctcctccttcccaatcatttctgtagaactgtaaagatttgctctatttagagattaagtatataaactttcatgtaattagccatattgataacctccagtaacacttttgggtacttagaacttatttgctgcctatgaatgattccatgaatgatcttcagtgctattaattagtctacaaatattcactgaggaataaccaaaacagaaaaaaaccccatccgaatggcactagtatactagtgagagggagatgaacaataagtaagattattacgtgaatatacactctgtcagaggtgataagtacgaaaaagaaaacaaaaaagcagatattatgggaaggcatttgaaatctttgacagcaagcctagcaaaggcctcactgtaaagtcacgcttgaataaatacataaaggatatgagggggcaacacatgcattatgaaaggccctgaggtggatctgcgtctgcgtacttgagtaagaccaatgaggtcagcatggctgaaggaagtaaatgaacaaacggttatagtgaaagatgtctgagaagtatacgtgaggtgtggtgaagatcatgtagagccttacaggttagcaaggaatcttttttttttttttctcagaataaaatgggaagtcactgaagagtgttaagtagagcagtgacatgactggacaatctatttacatcagtatggactcgtgtacttattctatggatgaaaatgcaatattatcattatttttgtggttgctaaaattggtccagttcttaggagctccttcaggtaggttcccgtgctttgaacaggttttcatctttttaagcacttcattactttctggcaccacaagatgatctaggcttaccttgtattttctctgcaccagtcccgtaaggaactacttctcaaggagccctggttcctttcattgaagagcaatggttggagaccaagatctaagcactaggtattctcaatgctactggggtgtcattgtttctatgccctctcaggggatagaggtaggaaatacacatattcaaattaactcatacatatgcacacatctatatttctgtatgtctgtgtaaatattaaaaaacatgagtttattttcatacttctgatctcaacactacagcatgactgtacagttctttttgcctctagttttatgttatttaatcaagacactattttctacagttacttaggtgagttctttccctccctatcctcttttatgtgaattttactattcctttttgggttctcctgcatctgggtaggtggtaattgcttatttggtctcccacatcctggttggtggcaattgcatagaagcatttaaaacattcctatggttctaagaatcagagttatactgacaaatatactctgagaagtgccactcacatttcatccatgctacacagatctccactcccttcttctccctcccactccctacaggtaaccaatctctagtttctgatttatctgcatggtactccattatatggctatatggatgtaacacagtttattcaaaccttctcctctgtgtgggcatttagtttgtttccaatatttcgcaaattaaataatactataattaataacattaagtaatacataatttgtattgttagaggcatattcagcatagattcctagaataattgagaggtaaatgcatacagtttgttaggtatcaccaaatttccctccaaaagatgtgtaccaatttgcatctgcagcagcaaagaatgagagtacctgtttccccacagccctgtcaacaaatgtgttgttttatgtttgaatttttgccagtgagacaagtcttcctttcttgagacaaagttctagctaactggtccatcttgtgcctatttgataatgaagaataatgaacaaaagccaggcgtggtggcacatgcctataatcccagtacttcgggaggatgaggtgggagtatcgcttaagctcaggagatagagactagcctggacaacacagcagaacctagcctctacaaaaaatttaaaaactagttaggcgaggtggcgcatgcctgtggtcccggatattcgggaggctcgggggagaactgtttgagcctgggaagccaagggtgccaatgagccgtgatcatgccactgctctccagcctggacaacagggtgagaccctggaaataagggaggaaagaagaggaaggaaggaaagaagagggaggaaggaaggaaggaaggaaggaaggaaggaaggaaggaaggaaggaaggaaggacggtaggaaggaaggaaggaagaaagaaaggaaggaaggaaggaaggaaggaaggaagacgaaggacagaagaggaaggaaagagggagggagggagggagggaaggagagagggagagagggagggaaggagggaggaagggaggggagaaggaagaaggacaaaacaaacaaccgtacaaatggcgacacaaaactgacactcctgtgagttttgagtgattcaatctagtggagaggtaaagatttgacagagttaccactagatcccttctaatccccacatggtctaccaactccaagtactcaatctgcatttaacttgcttaggcccaccaaattctaatgcctaaacaaagtcggaagggatgcaatgtctcctaagggcttgtgattcctctgccagtggtaggacacagtcttcatctctaaataccatttaattattaatcagtaagaacaaaaatggtaacttctgtccaaaagggacagagtgaggcaagttttcttttaactaccttcctagcaaacagaggtaggaaatacatggacacatacaaactcatgcaaatacatacacctacatttctgtactaagtatcaaacactacgagtttatattgattcctctggttctaatccaccaccaaaaagctcatttagcctttgttaccttccctgtaatacttttcactgtcacaaaatagcccaaaataaaaattacttttatgaagtaattcataaaacagatggttttcactgaaatatcattgtcttaatccagtctctaagaatgttcaggctggggaaaatactattatgcattaaactgttcaaaatttgatgacatatacactttaatgtaaaatttccaaaacaagcactctgacttcactactcttgaggtgatgcttactcatctatgtaaatcagttcattttgataatccaagtaaagctaatgttctaatgattgaatttttacttgaatctaagtccttgtctcaactatacttttgaaagctttgcctatgttctatctattaaagcccatatagtttctaaggtcaaaatttccagttttaatattccattggaagggctgtctcacttctcccaaatatacttgttaaaaaccaaaggggccaggcacagtggcttacacctgtaatcccagcacgtcaggaggccaaggcaggcagatcacctgaggtcaggagttcaagatcaggctggccaacgtagtgaaaccacatctctactaaatatacaaaaattagccggtgtggtggcacgagcctataatccaatctactcaggaggctgaggcggcagaatcacttgaacccaggaagcagaggttgcagtgagctgagatcatgccaccacactccagcctgcacaacacagcaaaactcctctcaaaaaaaaaaaaaaaaaaaaaaaaaaaggaaggccaggcacagtagctcacaactaaactcccagcactttgagaggccaagaagagaagagaggatcccttgggtccaggagtttgagaccagcctgggcaacatggtgagaccccatctctacattttaagaaaaaagaaaaagaaaagcaatttgtagacagcaaagcagtatcacttcacagagtttgctgtctttatagatgggaggaagccgtttcatttgcatttgtttcaaaattacatgaaaatcacaggaaaagctctgaaaaatggcagactatgcacatattactttgatacaatgcaataaagatgaactgaactgctgaccgaactaaaaaaatttttttaatcactttttaaaatatcaaacagaggtagtccacattatggactaatgaccttcaaatcttttcaaatattttctttcattttaaatcattatcaaatagttttgtcttaaaaagttaccacatgaatgtataagcatagtgcaaaattttcatttctaaaattttaatttctaatttaaatgtaaactacttattttaaaagattcaagttcactgagtaacatactacattccaatggcttacacaaattaatttttttttttttttttttttgaggcagggtctcactccaacgcccaggctggagtatggagtgcagtggtgcaatcatggctcactgcaacctcaatctactggactcaagcaatcttcccacctcagcaccccaagttgctgggtctacacatgtgcaccagcatgcccggctaatttttgcataaaataactttttttttttttttttttttttttttaattaaacggagtctctctctgtcacccaggttggagtgcaatggcgcaatcttggctacgggcaacctccacctcccagattcaagcaaattctcctgcctcagtgtcccaagtagctgggattacaggcgactgccaccatgcccagctaatttttgtatttttggtagagaaggggttttaccatgttggccaggctagtctcaaactcctgacatcaagtgatccacccacctcggcctcccaaagtgctgggattacaggtgtgagccaccatacctggcctagaatttctcttaataaaaattaataatttcctattttgagagcttttacactacagcaatcatttaataatcctttcaagtgaacttctgattaaagtgaatgttataaaactatgatttaaatatttgctttgtctacttacttctgtgctccctgagacaacagctttgtccacgttcactaacaatggttcttccatctggcatactcctagtgaccactccacacaacggtgatgagcccaacaagtgcctaaaatgggaaaaatgaaaaggagcaaatgagcaaacattaaaaaaattaaagctaataaataaagacataaaacttcaaaatcaactctaatatgtaaatatacaatggcatcctgtatttgtgatagcagtaaagtggcccttctaaaaatgtggaccaaccactgagtgccagtatcaatatcaaactgagaaattcttagaaatacagaatctgtctgggtgcagtggctcactcctgtaatctcagcactttgggaggccaacgctggtggatcttttgaggctgggaacttgagaccagcctggctaacatggcaaaaccctgtctctacaaattagctgggcgtggtggtgcacgcctgtaattccagctactcaggaggctgaggcatgagaatcgcttgaacccaggggacagaggttgcagtgagctgagatcgcaccactgcactccagcctatgcaacagagcaagactccgtctcaaaataaaaaccaaaaaaatgcagaagcgcagatcacaagtgagatctactgaatcaaaaactcgtgcagtggggcccagcaatctgtgtttggttctgtttttttttgttgttgttgttttgttttggttttgagacagggtctcactttttttgttgcccaggctgaagttcagtggcatgaacacagctcactgcagcctcaacctccagggttcaagcaatcctcctgtctcagccttgccaaatagctgggactacaggcacatgccaccacactccgggaatttttttcattttttgtagagacagggtttcaccatgttgcccagtctggtcttgaactcctgagttcaagcgatccacctacctcagcctgccaaagtgctgggattacgggctgtgagccaccgtgccctgccagcaatctgtgatttaacaagccgtctggttattatgatgcacacacaagtttaagaataactgaattagtgattatttcttcaacaaacaaaattagtttttagtcattttatttaaatattatatatgtatttgatatgtttctggtatctttatataaagcaaacaaagtattacttagtactttgttgaggtgatatacaaaggaaatgtatagaaaataaactacacatacacctctacttccctcatcccacagtgagagcacgtatcaatgattattaacacttcagcctttaaattatccatcacataacacttgaaccactatcagtcaatctgcagttcaactacagaatgagatgtactttaaattccagtagcaccatatcatgagtgctgagttacaatactgttataataagataatctacccggctaagacctattttcattcatgcccaaataaaatagactcagaatgccacattccccaagttctcactttaaaattttcccctttaaaattttctcttttctcaattgtcagatctccatggcaccgctatctacacaagaaaaaatacaagtattttaaaaagcatccagtccggtggtggtactgtacagattttaaatagataaaccttttcttttacctaaccaggcatatttaataatgatttttttatagtatgattataattatttctagatgaaaggtatttattattgaggacattaataatgtattaaaattaaaatgcttccagaattaagaggcagtcattattgaaaacatgcccatacctgtagaatcaaataaggcttggatatcaatggcatctggaagcccaaccagactgagttcatcccacagtttaccagcttgatcatctgaagctgtctgggtgcttacacttacacaagatactatattctgctgaggagatcgttctctgaaaataaaataaaataactgtgaaagtgaaaacaagcagaaaattgtttcatttttaactgtttaaatgcaatgtactgccaaatcaattttaatttatcagccattaactgtcataaaacaacttttagaattcatctgttagtattatccatggtataatattaaactgggttgccatattatatcgtataagtaacaagtaagaaaaagagtctccaaacccacagggaagtattaaattgtaaatttgtttttccattccataatataatgtttttaaaaccaactctcatatcctagtcaggaattgtatttaacacataaactgagtatttcctttggctttacttaaacgcttacaaaacaaaacttgatcaaatcagaaatgtttagtctgctgtatcttgactgaggactgccacaacagaggtggcagttaactgtgtaaagaaaggatattttccagggaaaatgaaaacccactacagagtgtgaaaacagaggcaggaggaatggaatgtatcagctgtagctttcttatggtcccgtcaacaaatctcaacagctggtctgtggcatgacgttgcaagtactctcaatcaagactgtatgtcacaaattggaagtaaaaagcaaaagcaaaatagctaccaaaggcatgtagaataaggaagatagtataacagcaaaaactatagtctaaaaaaagaacattgaataaagtaaacaacatatgggagatttcaggctttcaaggtctaacactttaggtattatttaagaccattaaataaataaaaatggctattgtacttaattattaaatatgggaaatcagatgactaccactaaaacttaaatcttctcctaatatcatagtatttaacctgatcataattctggattaaatcactattgaatatagatcataactcactgcacttctgtatgctggatatttatcatgattcctattaagagaaaatcagcacaatgaccagggtactaaacatttttatacctggaatcattgaaagaaaaaaagtattaacatatttcaataagtacatttaaatatcaaaccatataaaaataaccagtaatgtttttatgttcagcattagaaatgcatagactttttttaaaaggtatagcatgctatgctaactttaaattctcattttaataaatgcccacagtaaaatgagaacaaattctttcctataagtataatctctattcctacaaatatatgctccattacaaatcattgttattttattgggagaaaaaaaaaagaccaacagttcatctataactactaaatgttgttttagcatactgttttgcactagtatttgatgagggaaaggggtgtaaaaaaaccaagagaatgactaatttattactaatcaggtcctaaccagcagcttaatcaaattcaaccttcaagttttgagactggtttgtatgtatataccatatcagtaagatatcaatgtcaacactaaggatgacagcagcccagcttagaaagagatatcaagaggaatcagctgaaatgcatacccacaaaattcttagttataaaacaaaaaaaggaaaaaaattcttgatttttttatttagtgaaaatgagcaaagacattttcaaaacctttgtaaaattgttttttaaattaactagctatttaaacttcattagcaacatacattttgtaaatatttgaaatcattaccaagctaaattaattgcctacccttcaatgatgccaaatttttaagtgtacttcattaactgccatattatcattacttattaagttggtaagcactaagtatatataaagactttcgtttaacaaaggctatttttatataattatctgagctcataagaattttcactaaaaattaatttcacttttaaaacaaggaaatgaaaccaattccatttctcaggagaggattttatataattgccattatttaaggcagaacatgaggatataagatacagcctgattcactccattaaatttgctaatagacattttaagtttgctggccttttgattattttattaagatgtgtgtactcaactgacaactaaagaaaaagctatagcctccaaaacatcacaactctccaaatatagtacttctaagtttccttaaactgttccaccttaaattcttttaaaagattctccctctttttattgtttcatttcctacttcaggtcttcaaggcattggcagcagttcaaaacaatgagccaatcaaataagtacaacacaacaatgatttagtacttaaatttggatataagccagataagcacttgagtgattacatcataaccctcaagaggcagtgttagctttgcaagctaaattaatttttacacattctcatcaactacagaaacttctactcccttaaccagcacagccaagtctccatattaatatggtctttaaacacaactgtacaaaatattttaaactatatcagacaagacctttaggtaattacaatgtgcccgtgaatacagacatacacacatcattacaaaaaaaaaattccttaaaaaagaaaaaagcatcttctgggagggaaggcaggggagggagggagggaagaatgtataggacagtgcaacattttctgaagcacacaaacttatatataaattaaataaatgactgaatggattgatgaatgaatgacacaaaagacatgagtagtgaaaaccaattctggatttgctattgtattatgttatattcttaaaattaaaagcttatttagagaaacaaaagaaggactttattgatctgttttattattacattatttccatttataaattccatgaactccctccctctcagcttgtgttatgttctttgaagttttcttccaaaagtttagttttgtgatcacaccgctttcatatacaattaatataaactttttaaaaaataacaagaaaaatttgtgaaaaggatagtttgttggattaattgggttaatggtgagtcagagtatcccataaatgtggagaacaggagaaactgttcaacaagaacaatcccatttgaaaatttataaacattataatggaaataaattatatgcagtcttaatctattccaacatttaaagtcgaaactgcttactttctctgtcctctttgttttcgtggtgctgagttttgcattttctcataggttccattgctgttgtcatcaatgtccttcttgttagaaggttggtttctccatggcaagataaatccaggcgttattctgaattgttttaagtctccttgtcctaaggaacttttttccccacagtaacaaaaagcgcagagctgttcactagtaaaaatgaaatgtaagtcagagaaggagaaaagtagctttattcaactgctttaagcgataactatagatacttgtgcttttaaattatgtctaaagcacaagctaagcttttcaatctattttctacagtctattcagtgattacccataagaacaattaagtttaataattatacatttggaattctacttttccatagcattttaaaaagtagtacacatatcaaatccaaaaaattctagttagcagttagaaaagttattttcttttatatttgactagaaaaaaatccaagtaagaaagctaaaggtgggggccaagcacggtggctcatgcctgtaatcccagtactctgggaggtggaagttcgagaccagcctgtccaacgtggtgaaaccccatctctactaaaaatacaaaaattagctgggtgtggtggcacacccctgtaatcccagctactcgggtggctgaggcacctcgcttgtatccgggaggtagaggttgtagtaagctgagattgaaccactgcactccagcctgggtgacagagcaagactctgtctcaggaaacaaaaaaaatgcaagttaaaaatgggaaagaaggtagagtttagtagccacccaactgtatgacagttctgtaaaacatatggtgacagttttatttaaccacttgatagaacgttcattatgcatgatatatatataccacacacatgcatacacacggggagatataaaaatataaacttaaatagttcctgggttgagtggtagtagatttttagggaagcagaagagctgaactggaagaaggaaagggatgattaggagcaaaggggattttttaggccagtgaaaccattttatatgatactataatggtagatactgagccctaatgtaaactatggactgtagttaaaaataatgtatccatattggtttaccaactgtaacacagcacacaatactaatcatgagggaaactgctgggggtagaggtgggagaatgagctcaatttttgtgtaaacctaaaaatgctctaagtctattaataaaaaaggagaaaacattaaaaaattaagagacaacaatcaatatacatatatagaatatacacttactaagagatcttagaaagaatgaaattaaaaggactgcttcctcttgattatatttacacttcacaagatatttactgctgctatacccaaatcctccttcttgggcattaaagttacctctacagtatttaccccatgatcttacatatcttgcattaccaggtgatagaactaacctatagccttttgaggtgactttttaaaacttaggtttaaatcatattggactctcaactaattacttttatcaaaattagctttgtttttgtaataaattacctatttcaagttcatgagaaactatgttgtctgctggtaccgagacatacacaaattaaatgtagtgtaatttcaaaaaaaaaaatcaagtcaagttgaaaaagaaaatttcttctttccaaaaagagaccaccaccttatgctttgccagtatcttactatccccttatttgtaatgttctctgagctattaagcttacatttatttcaccatatcccatttctggtttgtttcttcccctagaaacactacccatgagaagcaacaatcagattgacattagtcttatcaacattgattgtaacagcactgattagaaaatggagcaatattttaaagctattgcagaaaaataccttagcattcaattttatattcaaaactatcgcttaaatgtgaaggtataataaaattactctctggcttagaagacctcagaaattttgccagacaacagatcaaaaatgaaaatacttttagagaagtacttaaattattaaagaattagaaaaggttgtatgaagtaagggaggtcaaacacctcagagtaatttattgttgacttttttttaatacgaggtcaagggaaatttctagcttttggtctggctgtagaaagctgcaaacaacattgtgcccaaccacacaacataacccaaccagagaatctgcaaattcacttttctgaaacccatcagagggcagaaatcacaaggcaaccaactcaccaccaaatgaaagacacttccataaagaaatgtgacaatagcacctctgaggaagaggccactgatatcataccagcagggtgataagaactcagtaaaaatttttaagaaattgctagaagccaagtgtgaaacacagtgagactatgttaacacctgtgaccaaagacaggggaattctaacccacacaaaggctcctcttcatgtacctcattagatgtcacgcactacagcaactcagccaggaacagtggctcacactgcaaccccagtgctttgggaggtcaaggcaggaggattgcttaaccccaggattttgagaccagcctgggcaacatagtgagaccctgcctgtattttaaaaagaaaaagaggatgggcatggtggctcacacctgtaatcccagcactttgggaggccgagacgggcagatcacaggtctggagttcgagaccagcccagccaacatggtgaaaccccgtctctactaaaaatacaaaaattagccaggcatggtggcaggcgcccgtaatccaagctactcgggaggctgaggcaggagaatcacttaaacccaggaggcggaggttgcaatgaactgagatcgtgccactgcactccagcctaggcgacagagcaagactccacctcaaaaacaaataaaagaaagaaaaaacatatatacagtgactaaaaaacattttctaaaatagcatacgaaatcttactagccattacaataatgtaaaccaaaaccaccaattaaaaggcaaaaatcaccaattaaaagaccatttttgagattagattaaaattagatctaacaattgggtgcagctgggtgtggtggcacacacctgtaatcccagcactttgggaggcctagttgggcagatcacctgaggtcagttcgaaatcactctggccaacatggtgaagcacacaccacccacccaccccctccccatctctactaaaaatacaaaaaaattagccaggcattgatggtgtgcgcctgtaatcccagctactcgggaggctgaggcaggggaattgtttgaaccagggaggtagaggttgcagtgagccgagatcgcaccactgccctccaacctgggcaacagagcaagactccatctcaaaaaaaaaaaaaaaaaaaaaataggtgcaaaaaatgttggaagtataaacacaaatgacatataaaacaaggacaaaaatgttgatgggaaaagaggtaaaaagataccaggcaaacataaaccaaaaggaagtttgagtggcaataattttatcagacaaaatgaaagttatgtcaaaaagaaaacatgacattagagatgaaaaagatgttacacactaacaaaatgatgaatagtataatagatatcgatcataaccatatactcagaccaacatgaatctggtctcaaaatgaatctcgaatctgaaagagatggttaagcatctccaatctgaaaatccaaaatctgaaatgctccgaaattcaaaactttttaagcaccaacatgatatcacaagtagaaaatttcacacctaagtacttaatataaactttgtttcaagcataaaattacttaaatattctataaaattaccttcaggctatgtgtataaggtatatacgaaacataaatgaatttctgtgggcagcaagccacccaggtgccgaggcaagagaccaagggcacgagctgttccagtataacaaaatatataaaataagaatagttatatagatcatagatatgattatacatgaatatcattaatcattagtttgtagcaattactctttattccaatattataataatcctcactctacaatcataacctaggaaaaaccaggccatacagcaataggagctgaggggacatagtgagaagtgaccagaagacaagagtgcgagccttctgttatgcccagacagggccaccagaggagtccttggtcccagcgtctgggaagacacctgttgccaagtggaccgtggtctagcggtagcgtcagtgtcaaggaaaaacacccactacttagcagaccgggaaagggagtctctaaactcttttagagtttagagaagactctactcctccacctcttgtggagggcctgacatcagtcaggcccgcccgcagttatccagaggcctaaccgtctgcctgtgatgccgtgctgcagtggtcacgctcctagtccgccttcatgtttcatcctgtacagctggctctgccttttagatagcagtagaaaattagtgaaagtactaaaagtctctgataagcagaaataatggcataagctctccctctccctctccctttccctctctctgcctcagctgccaggcagggaagggctccctgtccactggacatgtgacccacgtgaccttacctatcactggagatggctcacactccttaccctgcccctttgtcttgtatccaatacatatctgcgcagcctggcattcagggccactaccggtctccgcgtcttggtggtagtggtcccccgggcccagctgtcttttcttttatctctgtcttgtgtctttatttctatactctcgtctccgcacacggggagaaaacccaccgaacctgtggggctggaccctacaaatttcatgtttatacatgtctcccatccccaaaatatcttattatgtatgtgcaaatattccaaaatccaaaaaaaatccaaaatccaaaacacatctggtcccaaacattttgtttttgttttttttgagatggagtctcactccgttgtccaggctggagtgcaatggtacggtcttggctcactgtaacctccacctcctgggttcaagcaattctcctgcctcagcctcccgagtagctgggactacaggcacacgccacaacatctagctaatttttgtatttttagtagagacggagttttgccatggtggccaggctggtctcaaactcctggcctcaggtgatccacctgccttggccacctaaagtgatggaattacaggcatgaaccaccacacctggcctgtcccaagcattttggataggagaaactcaacctgagtttctcagaacaaaactggaagactaaaaaaattaaatcaacaacagtggaagattttaattatttttctcagaaaatactatgtcaaaccaataaaaattaagtattgaacatctttattgttcattatttattaattacctgagcataataaattagtttgagatactatattcagctctatctacaactaacggttcacattcttttcaagtatattaaaatatttcaagagtggattacatagtaggccataaaagaatacatgatacatagcaagtgaccaacatcatgcaggcaacattctctgacaataatgcagtaaaactaaaaatgtataataaatggataacttaaaatcttctggccaggtgcagtggctcatgcctataattccaacactttaggaggctgaggcaggtggatcacctgaggtcagcagtttgagaccagcctgaccaacatggcgaaaccccgtctctactaaaaatacaaaagttagctgggtatggtggcacacgcctgtagtcccagctactcaggaggctgaggcaggagaatcgcttgaacctaggaggtggtggttccagtgagccaagatcgcaccattgcatagcctgggcaacagagcaagactccctttcaagaaaataaataaataaataaataaataaatttggaaactagaaaagatattgtttaagaatctttcacttaaaatggaaatcccaatatgtgaaataaaatcataatgaaaatactgaatataaaattgatataaaatataaaatactgaatataaaaatttcaatatattactggaagtcctaggcagagcaatatggtcaagagaaagacataagggatcccagtaggaaaggaagaagtgaaactgtctttatttgctgatggcatgatcttatatatggaaaaccctaaagactccaccaaaaaactgttagaactaataaacaaatttgataaagtagcaggatacaaagtaaatatacaaaaatcagtagcatttctatatactaacagcaaacgatcctaaaagaaaattaatgtaataatcccatttacaatagcaacaaaaaaattaaatacttaggtgtaatttcaaccagggaggtaaaagacctgtatactgaaaaccataaaactcacaaaagaaatttaagaaaacatcaagaaatgggaagatatcctatgttcatggactggaagaattaatactgtgaaactaactgtccatactacccaaagtgatctacagattcaatgcaatatctatcgaaattccaatgtcaattttcacagaaataaattatccttaaatttatatggaagcacagaagacatcaaacagccgaaacaaccttgagcaaaaagaacaatgctggatgcatcaccctgtctgatttcaaaacattacaaaatgattgtaatcaaaatagtatggtactggcaccaaaaaaaaaaaaaccatacatctggacaggcatggtggttcacacttgtaatgccagcacttgggtaggctgaggcaggcagactgcttgagcccagagtctgaaaccagcctgggcaacatggtgaaaccccgtctctactaaaaatacgaaaataagccaggggtggtagtgaacacctgtagtcccaggtactcaagaggctgaggtgggtggacggctccagctcagaagacagaggttgcagaaagccaagatcacaccaccgcactccagcctgggctacaaataccaccctggctcaaaaaacaagaagacacatcgaccaatggaacaggaatgaactcacgcatttacactaagttgatttataacaaagatgccaagaaaacacaatgggtaaagaactgtctcctcaataaatggcactgaaaaaactgtatatccatatgcacaagaataaaatcatacccttgtctcacataacacaaaaaatcaattcaaaatagatgaaagtcttatgtttcggatgtcaaactataaaactactagaataaaacatagggagaaagttccatgtgggcaataactttttggatatgaccctgaaagcataggcaacaaaagcagtaatagacaaatgggatggctaaaccaccaagctccttacggcaaatgaaaatattaacaaagtaaagagacaacccacagaatgggagaaaatatttaatatccaaaatatatatggaacccaaataaacagcaagaaaacaacctgattaaaaaatgggcaaaggacctgaacagacatttctcaaaagaacacatacaaatggccaacaggtacatgagaaaatgttcagcatcactactcattagggaaatgaaaattaaaacaagtatatatcacgtaacacctggctattggctaacacctaacaaatggctactattaaaaagatgaaagataagtattgccaaggatacagaaaaaatgggagtcctgtacattgctgtgggggtgtcaattagtatagccattatggaaaatggtaaagaggttcctcaaaaaactaaaaatagaattaccatataatctagtaatcacacttctgggtatatatccaaaggaactgaaatcaatgtcaaaaggatatctgcatgcccatgcttactacagcattacttacaatagccagatatggaatcaacctaagtatccatcaatagatgaatggataaagaaaacatggtatatataaacaatggaatactattcagccttgaaaagcgggaggatggggagtggtggctcatgcctataatcccagcacttcgggaggccaaggctggaggactgcttgagcccagatattcaaaaccagcctgggcaacacagtaagactccatctctacataaaattttaaaaattagcctggtgtggtgagcacacaactgtagtcccagccacttggaggctgtggtgggaggattgcctgagcccaggaagttgagactgcagtgagttgtgagcatggcactgtactccagcctgggcaacagagtgacaccctttcaaagaaaaaaaaaaagagagagaaagagaaagaaaggaaggaaagaaaaaaaggaaagaaggaaggaaggaagggaaggagggagggacgaagggagagaaggaaggaaaaaagagggagggaaggggaggtagaaaaagagggggaggggaagggaagggaggcagggaggggaggggaaggggattaaggaagagtggggagagagagagagagagaagcgggagggacctgtcatctgcaacaactcagatgaatctagaggatatcatgctaagtgaaataatccaggcacagaaagacaaatacggcatgatctcacttatatgtagaatctaaaaaagttgaactaaaagaaccagtagtagagtgatggtaaccagacactcggagaaggtaaggcaggaagaaggaaatagtaagttgttggtcaaaggatatgaagattgagataggaggaataggttttgagatatactacatagtagggtgacctatattttaaaataacaatttggtgcaaaggatacgaaggttgagacaggaggaataggttttgagatacagtgcatagcagggtgacctatattttaaaataactattagtttggtgcaaaagtgattgtggttctgccattaaaagtaatggcaaaaaccgcaatcacttttgcaccaacttaagagtaaatttcaagtaacaaatgagagttaatcaaggtaatggatgttaatttacttgattcaatcattccactttgcattcatgaattgaaacatcacactgtactcataaatgtacaattaggatttgccaatcaaaaataacattcaaaaataataaatgtatcatgaatcattttagataaaatgtatatgttctgagaaaaatataacatgagaaaattggtacaagatgaaacagacagctgaatagaaaaaaatttggaagtggggagcaaatttatggaatacatattccaagaaaaaaaatctttgaattgaactggtaatgacttcattttctagaagaaaccccacagacccatgtaattttatgacagttacttcagacctacatggagtcaattcctgtcttaaactagctgttccagaaaataagaaaactgaaagatgcctcacacacgaggctagtgtaattttgtctccaaaactaggacattacaatattacaaaaattcatattgcttatgaacataaacaaaatattagctaactaaaacccaacagcatgtttaaaaaatgtcataatcaagtaatgtttattgaaagtaatcgagtaatgtttattgcaagtaatcaagtaatgcttactgccttctacagaagcttcttcttattgcattgttttgcttcatttttaaatacatatgaacataagttctttgttagttatatgctttagaaatatttttcccttttctgtcatttatctttttactcttggtatttttcatgaaaagttgtaaatttaagtatagtggtattaatcaatccttttcttttctttttttgagatgcagtttctctcttgtcgcccaggctggagtgcaatggtgcgatcttggctcactgcaacgtccacctcccaggttcaagcaattttgcctcagcctcccaagtagctgggactacaggtgcccaccaccacgcccagctaatttttgtatttttagtagagatggggtttcaccatgttggccaggctggtcccaaactcctgacctcagggatccacccaccttagcctcccaaagggctgggattacaggcatgagccaccgcacccggccccttttctttttatgtgtgttttttttttttgagacagggtctcactatgtcacccaggctggagtgcagtggcaggatcacagctcactacagcctcgacctcctgggctcaagcgatcctcccacctcagcctcctgagtagcaccaccaagtcctactaatttttgtattttttgtagagacagggctttgtcatgttcaagtcaggctggtctcgaactcctgggctcaagcaatcctcctgcctcaacctcccaaagtgctaggattataggcatgagccactgtgcctggccaatcaacccttttctataattagggctttccatttgttttttaaaagtctttccttaccccaaagcaatgaagaaattcctctacattaacttcttttattaatttgcttctcacgtgttaagtctataaattaactggagtagacatgaataaattaggtctttctttttttttttttttaaagtatgtctaattgttctagcacaattgttgaaagagacttccttcctcactaatttgtgatgcccctttgttataaataacctgtccatattaatcatgtatctgtatctgggttccctattctgatccattggtctatttgtctgtttctgtggtaatacagcactgacttaatttattagtgtgttacaaaaagtcttagtatcaagtaaagcaatccttcctcttcttcatgggtcctttggcttatcctgtcttttgcatattcatataaattaagatcagcttgtaaaatttactgtagaaatttttattagaattttcttgaacctacacatcaattgggaaagaatatctttaaaatactgaatcccctaaaatgtgagtattatactgctattatgtctgtgatccttaatctttccaaaaagttttataattttctctataaaagtcttacatttttgcacataatcctagtcacatattattttatattattggaaaatattctaaaaaataccatttaactctgttcctaatatataaaaatacatgtgatttttgcattttgattttgttatctagtaatcttgctaaaatcctattaattatacatattcatttagaacattttatatactgcaccattaaaattcattaaattcaggccggggacggtggctcacgcctgtaatcccagcactttgggaggccgagatgtgcagatcacgaggtcaggagatcgagaccatcctggctaacatggtgaaaccctgtctctactaaaaatacaaaaaaattagccgggtgtggtggcaggcgcctgtggtcccagctacttgggaggctgaggcaggagaatcgcgcgaacccgggaggcggagcctgcagtgagctgagatcgtgccactgcactccagcctgggcgacagagcaagactctgtctcaaaaaaaataaaataaaataaaattcattaaattcaatctgttcatcctattttaaggaaactgtgggacagagagataaaaatgaataaataaaggtcaaaaagtcggagcttggaataaacaccaagtctgtatttacagtatgctggctttctcagtgtacattcactctgtcctgtctaatgaaaataacagtggtagtggtagtatagcccaggataaataaataacaatggcattgcttattaatctacctcaaggttatttttccatgtggcatgagcatcaatctacctatattttttacatggatagccaattattgagtgacctattcttttccactgataggccatgattattataaatgaaattatcatatattcatgagtagcttttaactttcattctctgtacaagtattagatgaggactaacagtgacagtgtgctactcacaggtgacaaaaagataagtcagtcaggcatactgtgtccttaagatctgcagaagaaccaagcaagaaggttaagaactacaatgggttcccgaagtaggcctagaggatacagaggcacagaatactttcagaaggctctcaggcacctgctctaaactagcaaatattctgcattctgtacctctcaataccacatatgcattacaccatttctaatctctatataacacatagcaaaaagtaaagttcatggtagtatcaaactacaaaaatttaagcagaactttaaatgcttttcaatcaactagaattcattattcattaaaaatatattgggccgggcgcggtgactcacgcctgtactcccaacactttgggaggccaaggcgggtggatcacgaggtcaggagatcaaggccatcctggctaacacattgaaaccccgtctctactaaaaatacaaaaaattagccgggcgtggtggcgggcacctgtagtcccagctactcaggaggctgaggcagaagaatggcgtgaacccaggaggtggagcttgcagtgagccaagatcgcgccactgcattccagcctgggcaacagagcgagactccgcctcaaaaaaaaaaaaaaaaaagaaaaaagaaaaaaaaatttatacagcacctaatctccgtcaggaactattaagtgcaggacacagtgtggtgaacaaagcccaccaacaaagtgcgtgtcttcagagttcacatgacagtcaaatgaactgttggaaaataataagtgccacaaagaaaaataaagcaggttactatgtaaaatatggtgggagctgctgttttcttttccatcctactcctttattttgaaaatgttcaaacctcccaaaaaatattggaggaggaggagaggactacagtataacaaacaccagtgtgttctttcgttgattcacattgtatgttctttttcctaagctgactgagactaagctggatgtggcccttcagaggaggctagtattatcagcaaggtagcctctctgggaggtaagccaggagacaagcagagcaagcaccaaagctctcagacagaaaccccatcagcacatttaaaagagtgaggccaatgtggtgagagcacagtgagtgacaaatgacatgagagaggcagtcaggaacagatcacaccttgtagacatggtaagtacttgaaattatgaatataatttaaatataatagtcatgaaagagagtggagagtggggacctgattatcattattagaataatttttgcaactgtgctataaacaaattggactatggaaaggtaaagagaagcagaaagactggttaaaaggctactacaacttccaaaggataacagtgacttcaactaaaatgttaggcaagttaagacactaacaagttgtttgggttatcgagttgagctacaaggtatgagaaaagatagaaatcaaggattaactttcaaagtttctggactaaacaactgagtgaatactggcattatttattgaaatgaggaaatcgtagggagaagcagatttggggcagaggtggaggcagaatcaagcatggtactggacatgttaagggtgaggtgtctaatacacttccaaatagagacgtcaagcagacagttggacataaaagtctggagttcaggtaaagaagagtaacggaaatgaacacgtgagactcttaagggcacacacagaggttacagccattagaatgaatgagctttctttcccagggagtgaacagagacaaaaagtagacaagatatctgaggacttatccttaagaactccaaaattataaacatgtagagtctccacagcaactagcaaaagataaaatgaggagtgagatgtcccaaaagcaaaagaaagaaaatggttcaagaagatgagagaggtcaggtgcagtggttcatgcttgcacttccaccacttagggaggctgagacaggaggattgctttagcccaggagttccagaccaacctggataacataaagagacccagtctctaccaaaaaaaaagcttaaaaattagccaagtatggtggcacacacctgtagtcccagccacctgggaggctaaggtgggaggatcacctgagcctgggaggttgagcctgcagtgagctgtgatcacactactgcactctaccctgggcaacagagtaagaccttgcctcaaaaaataaaaaaaaaaagaaaggaaaggaagaaaagggaagaggaaaaggaagtagaagggaaacgaagggaggaaggagggagaagggatggaggggaaggagggagaaagggagggaaggagggcgggaaggaaggagggaaagaagggagggagacaggtaaggagggagggaaggaaggagatgggagtaccaaactgatggataatttcattattttattcatgtctttcaaataaggtctaaaaactcttaaaacttcaaagctgaattatacaatgatatattacaggcccagtgtagtggctcatgcctgtaatcccagcactttgggaagccgaggcaggtggatcatgagatcaggagatcgagaccatcctggccaacatggtgaaaccctgtctctactaaaaacacaaaaattagctgggcatggtggtgcatgcctataatcctagctactcaggagcctgaggcagaagactctcttgaaccagggaattggaggttgcagtgagctgagatggcaccactgcactccagcttggtgacagagcaagacgccatctcaaaaaaagggagggggggaggggtggtggggggggggagaaaaagaaagaaaaaaaataggttataatgtcctgtgtttccttttttaatgaatggggagaaggtaaggaacaaaactatcaacttaagtttacaggtaagtatcaaaaattaatcctcatgctaaatgctcacatttatgtcttctgccaggaacagcacattggtaatattctgtactggcctgaggtgactagagtaaaaccgtagtgtgctgccctgctctacaattgcctaagcccacagatgtaactcatcccaactaaacacagaggtatcagcttcaaatttagctactaaatcataaaatcccacccagattttcatcctaaactcatactccttgaattttctctatagtcatttcactgctttattcctgtcactaatatccaatccagctgcattcattctctaacctgattttggcttctacaccaacagagaccagggagtttgccgattcctcagacacagatcgctgaagagttggaattagctgtttgctgttatccacttctgcttcagcatcctcttctgcagattgttctttgatttctgcttaacagtaaacaagagaaaacaaagagtcatttttgtgtttattttaatcactggtgaatgtatctataaagcataggtcataatgtaaaaagaaacaacaaataacaatatttcactaacacaagaaaagttcatgcacgtaattagtggtattgtgcatctttattctctaccgcaaaatgattatcaaaataatgtgaagcatggtatacttttccttgtgcccaaattatagctgactcagagaagtttcatcctagtaataaatgttaagaatcttggccaggcatggtggctcatgcctgtaatccctgcactttgagaggccaaggcaagcaaatcccttgagctcaggagtttcagactggcctgggcaagatggtgaaacctcatctcaacaaaaaatgtaaaaattagccaggcaaggtggtgagtgcttataatgtcagctactcaggaggctgagatggaaggatatgccttgaacctgggagccagaggctgcagtgagctgggatcgtgccactgtactcaggcctaggtgacaaagccagaccctgtctcaaaaaaaaaaaaagaatcttatttttggccaggtgtagtggctcacacatgtaatcccagcaccttgggaggctgaggcaggcatattgcttgagcccagtagttcaagacagcctgggaaacatggtaacaccccatctctacaaaaaattagctaagcatagtggcacacacctgtagtcctagcgactctggtggctgaggtgggagaatcaatcaagccccggcagcggaggctacagtgagctgtgatggcaccactggactccagcctaagcaacacatctagatcctacctcaacaacaacaacaacaacaacaacaacaaaaagatttttttttttttttttttttttttgatggagtctcgctctgtccacccaggctggaatgcaatggcgcgatctcgactcactgccacctctgcctcccgggttcaagcaattctcctgcctcagcctcctgaatagctgggatgacaggcgcccaccaccatgcctggctaatttttgtatttttagtagagactgggtttcaccacgttggccaggccggtcttgaactcctgacctcaggtgatccacctgcctcggcctcccaaaatgctggaattacaggcatgagccactgtgcccggccaaaaaaaaatcttatttcaggattatagcaattggtctacagaacaaatgtatttcaaagtgactcattaaaaattgcttcacactttataaaatcatcattaaaagactcatcatgtatcttaattattacccattctaaaagcttaatatttgaaaaggacaaaccttcactttattgcctttttccattctccttgaatccaaccccaaacaccttaaatgttctttctcaggaggcagcctaacagctgagaggatttccacacaccactacccctaacatcattcttcttgtttaataaaaattatatgtccactctgtctgtcatgctctattactacaatgaagggacattacacctccccaccagtgctcatgatgcagttccatgctcttggctggctccttcttttctaatttgaaatttatttagacctttctgcatcactaaccccaaacaaacaaaaacatcttaaagtcctttcaagcgcctcttctctgtctttccttttaccaccaaattcatgagatggcatgactgaactctactaccttccccttcaactatacctttctaattgtatccagcctcctattataacaattattctcagctgggtatggtgatgcacacctgtaatcccagcactttgggaggccaaggtgggcggataacctgaggtccagagttcgagaccagcctgaccaacaacatggtgaaaccctgtctctactaaaaatataaaattagccgggcttggtggcacatgcctgtaatcccagctactcgggaggctgaggcaggagaattgcttaaacctgggagatggaagttgcagtgagccgagatcatgccattgcactccagcctgggcaacaggaatgaaactgcgtctcaaaacacacacacacacacacacacacacacacacacacacacaaattattctcgtcaacaccaccaatagaccaacggcaaaagaattaacaatccagttagcacccacaagctttcttcaaacatcctaaaagttcacttcacaccaggatcacttcctccttagtgaaatgatcttctatcttttataagcacagagatataatagtctaatatctatctcttcagctgatttcctttagacctctaaatataggtacagccctctatacatcctttatatactcctggggttgggtggttgtttttgtttttgagaaaaggactcactctgtcgcccatgctggagtgcagtagtatgatcattcgcattcttgggctcaagaatcctcccacctcagcctcccaagcagctgggaccacaggcacatgtcaccacattctttttcatttttttgtagagatgggggtctcactatgttgcccaggctagtctcaaactcctggcctcaaatcatcctcctgccttggcctcccaaagtgccaagaatacaggcatgagtcactactcccagcctataagctcctctttgaagaacttattatccacatttcaacaatttcctctggactttatgatttgtaagtcaacatctctagcactaactcctctcctgagttccacaccatattttaactatacactagacatacttagcagcttgaacactaaatttcacacaaaactttatctcttatcgctcagattagcacttcaatctgacttccctctttaaaaaaagaaaactatcttctacattcaaaatgaattttagaaaagtattttgaaaaacaatttgtataactattcttgggtagttagaaaaaactacaaataattgtaaatcctatcaaatcataaaactaatgataacatgaagcatcaaacagatggttttggttttcatacttaaaataacatgtttcttttcttttttaaaaaattgaaatagaaaagctgaccttaaattaagtgtttatacagtctatcaatcaaggtgtcctgtctatcccgagacaaaattgataaagtatctagaatcaaatctacaaatacgtaagcttgtattcaaaaggaataataaaatgaaaatttacatttctatgtgacaaatgacctcatgaacaaaatgaatgtgtcacagatgagagaaaataaatacaatttgaatccccccccaaaaaaaaaggtattcagatcaagaatagctaaataactccaaagatgaacaaggcacataaacctgtagaacgtagacaaaggggccgggtgcggtggctcacgcctgtaatcccagcactttgggaggccaaggcaggcagatcacctgaggtcaggagttcgagaccagcctcaacatggagaaaccccatctctactaaaaatacagaattagccgggcgaggtggtgcgtgcctgtaatcccagctattcagaaggctgaggcaggagaattgcttgaacttgggaggcggaggttgcggtgagccgagatcatgccattgcactcaagcctgggcaacaagagcaaaactccgtctcaaaaaaagaaagaaagaaagtagacaaaggacaaaatccatactcttcatcttctatgctttccaagttttagtaggacacataactgctcagctagagactttattccccaaccctctttgcagcaaaccatggcaagttctcaccgagagaatatgaccagaagcaactgcgcaacctcatcatctaaaaggaagtgagctgctcttcactaaattatagtcccctttcctacagactggaatggacatgacagcaacccagtcgcaatgctgccaatgaggcgcaatgctccaggtgatggcagagagacaagacagaagaaacctgggtcaacaaacaataatatggagcaaaagacaactcatcagcctatacctctccatcctcagaaatattacatgagagaagatcaatttgttttatttaagccactgctatattttggggtctctgttacagcagtttaacccatgccctaattaacacagaaaactggtattaaagagtgaagaattgccgtaacaaaatcttcaagtggcttgatcaggccgtgaaacactgataatggagtctgaaaatcaactgaccctttttaggctatattaaaatatttaatatagctatgacctacaacaatttggaatgtagactgtacctacagagcctgtagctctaggcaaagcatctggaatgacccaaagggtattctgtgttgcctctctctagtatttttacagccaaagatagaaaagaatacagttctgctagagagactctctctgcctgcctattatattcaaagtactataaaattatcacatatataaatacctgtatgaaagcatttcatttctactcagagagtcccagaatacattttgggatatacccattttataccattcttactactgggtaacaagaaaggggaagagaaaaataagtgacaaacttaaggaggaataagaatagtgccttcagaaacttaccaacaatgagccaaatggcccagggtcgcaaatcattacattaccctgaaaacacattttttcctggagccagatccatttgtctccactcccaagctgtgctctctccaatccagtatgacttgtctgcttccttttactatgctgctatctaccatatatgacctccagtcaaaaatttccttctcctagcgaagtatataacagtttcagctttttccttatttttatccccaaaaaagaaaatacatagcacttttattatttttaggggagttttattgcttacagctaagggaaaagaagcaggacaatgtctatctctccctcaaataagagccagaaggaaatagaaaagttaaacgttaatgttactggttggccagtaggtttgcaggtatacaaccttttgaaattatgtttcctgcatttcaaagagaaaaaaacagattcagactatagggtttttttgttttttttttgttttttaagaaataggatcggcaccagatctgatcccataaagcaggtaagaagacaggctttcagagttcatcctgttctcttttctcctctagctattattattactggctctgcccatgattctaacttggatctgctaaagaaacagtagggagcgatagttttggttttacttttggtttagattttgttgtttcagtcttgtgttctttaacaaataaagaggactctatgactgcttcctagatagcagtaattcctgccacaaaataggaacaaacaacaaaaaaggtatcactaaatatttgatacttcaggtaataacagaagctgtctttaactgtcactcttcatttggtagactatgttagatcttagtatctgtcaaagtcaaggcaggacaactgagtgtttatgtctctctctcttctcctaatcctagtcttcaaacaattgtcagagtttggcagcagaatgtgaaacagactgctctggataaaaatgatgtcaaccagggatccaaccagagatgtcatccagagatgctctggatgaaatggctacaaacccagtgatatctgaggaaatatgcctgatgccagtacttaattatctccagtttattattaaaaatgtactcttgaatactatcctatgctttgcctaaagaaagaagctagccattcaaccaataaaacagtccaggtttggcgactccaccactttgcagagtttttgcctttcatgaggtccaattagctcaaactgcctgcaagccaaactgtggaaattggagcagacatttaaaaaattacattgcatttttaaaaattcagtgtggtatttttcttgaatataaaatccctaatatatcttttcccttactttgaacctgacctaaaatacaggcaatgacacttggtcacaaaatgcaccaaagtcagaaaggtggggacaactgcaaccctgggataaggacaggcaaggcgatttcatctgtagccactatctacggataatctccatccactaggtggcacatgtacagtggtaaactatactaaggaacctaatcattgacctggcgtggtggctcaagcctgtaatcccagcactttgggaagcaggaggatcacttaagcccagaagttcaagaccagcctgggcaacatggcaaaagcaaaaaaaattcagccggccttggtggcacacaccagtagacccagctattcaggaggctgaggtggaagaatcacttgagcctgggaggcagaggttgcagctgcaccaagatcacaccactgcactccatcctgggtgacagagcaagtccctgtctcaacaacaacaataaaaaagagaacctaatcacatgtaagtagattcctaagagaacttgaagacaatgtgcacttcattaaatagcatcagctatgtgccaggcattatctctggggatgcaaagataaattagatctaaccctttcccttaaataagttcataacataccctcttttaaacctttacttttccacctccaatgactctaatttatcctacacaaattggttctaagacatgagaaagtttaatagcaaaaggtgtctgctgtgttagttaaaaccaaaggcttggaatccaatggttccgagtctgcattctagctctgccatctgctagcaatgtgacctttggcaagttacttaacttcatctcaattttactttgctcgtcatttaagacagacaataccacctagtataaaactgtctttatgatccaaaaataaaaaaaaaagaacgcatgaaaagcacttagctcaacgtcttaagtgtagtgatgtagctgctattctgatgacctctatctacattcacacactatagtctatggattcacttgtccacctcacttatacaacttgatttttttttttttttttaaagacagagtctcgctctgccgcccaggctggagtgcagtggcgcgatctcagctcactgaaagctctgcctcccaggttcacgccattctcctgcctcagcctcccaagtagctgggactacaggcgcccggcaccacacctggctaattttttgtatttttttagtagagacggggtttcactgtgttagccaggatggtcacgatctcctgacctcgtgatccgcttgcctcagcctcccaaagtgctgggattacaggcatgagccaccgtgcccagccctcacctactcaatttctaactcttgatgtcacatcatgaattattaaattgcattatgagaattaatgagaataaagaagacatttatttagccccctccgatctatgctccagagttaatatatcattaatttagaatggttatttaccaaacaaaattttgagtaacaagtacatactataatttctattcaaatggtagtcattacaaagatagtcaagatccctacgtttaatggatctagatgaaagactgaaaataaaaataggacacaataatgatgatgctggtaagcacatggcatgatgggagttaaggggaagaggtggggaatacagctcagaaaggcttcagaaaggtattagaagcccagctaaaactaaaaggataaatcaaagtgtgcctaatagttctctctcaagttttctcttttaaaaaaagaataacatctaacatattttcttcattcaaaagataaggaaactaaaatctgaaagttaattacaagctcaagatcacaaagctaataggaaacaaagctgggatacaaaatcgggttgtgtaactctaaagcctgatgtgctcttttcactacttccaccgcctggcagagcatcaaagtgtagcatgtaagttttataaatacatcaatattaaagagaaatgttaacagtcttactaggaccatgttactgagggatcacttactgaatataaacactatgagataactaaaaatactcttttttaagcactgctgaataaaattatgaagtggacagaacatttatctcacagccaagttcacagaaataaagcattttgattttgaacaattacaaaagtatttccctcaaaggttaaatacttctttgaaaggactgtgtgtagcctacaaatatactgaacaaacttaccaacactgatagcataacaggctatgtcaaaaatattttagaggtcaattttggactcccttatcaatacattagtatattctttcaaagcgtcctactttttcaatggatttttaaagtttactcactcaagggttataggattttagagggagaaattacttctttatttttactaacctctaatttttattcacttccaaaatttagaattctaagaaaatattaagaatgtaagcaacaagcacagtggtattggtggatacctaagtgtttgtcaccaacagaaatcacggatattttcttatcacatgcagttgttgcagatatcccaaaatatcattcaccctcatcactacttcaaaattacagtagttattaaattcactgctagattttataatttaagtgaattaaaaagatgttataagattacaagtttggcttatttttatttcaatgcaattgtttatctttgtaatcctattttggtgtatttttattttattcatttaaaaacattatttgaaaaagagtccatggattacatcatagtaccaaaggggactatggcactgaaaaagttaagaacccctgttctgtatgtgccattcacaggagaccacagccccaatttgactatatgctctatgaaaacaggcactgtatctgtttttataaaccagagctaccacaaaacctgaatgatgttcgatagttgcttaattaatattatataatataaagcaagcagataaatctcatatatagatacaaagatttataaaaagcacagagaaaaataatatatttaaaatgaactcatatttactaactatgcaagtaaacactgacattcattatcgactagttatccaaaaaatatgccttctccctctatgctttaatcaacttttttttttaagagatgggctcatgctctgtcacccaggctagagtacagtggcacaatcatagctcatcagaacctcaaactcctgggctgaaggtatcctcccacctcagcttccccactagccaggactacaaggcacatgcgatcacgcctggatttttttttttttttttttggtagagacagggattaactatgttgcccaggctggtctcgaactcctgggctccagttatcctcccacctcagcctcccaaagtgctagaattacaggcatgagccaccatcaccatgcccagcctaatcagctattaaatagaataactgacttcccttaactccagagaatggcaatacttttcatgcttgcttcctactaaaactacagaagaaaacatagctaagaaattgtgtaaccatgtccctcccttcttttgaaagaagtctgcctcctgacagttatgttttctggatatatctcattgaatctagtgtatccaatgtcatcaaaattgtactgtaaagctaaaacattagcactatattagaaaaagcaaattatttattaacactatctttattcactaaactacttaaaatattgacactgattaataatatgaatatagttgctgctttcacagaacaatgtaagcaactaaaagtaaatacacaaaaaaagcactaattttctctgagagttaacacttttacaggtgacttactctctttataattacccacagttccataaatttctacaaatatacattactgttataatatttaatgtgattttttaatgcaaattcaaaaagcttaagagtccaatacttgtcaaaagccaaaaaatatgcgggcattaatttaaatagtaattgtttaagcaggatagactgctaataaatgaaaaaaaatagtaactgttggaagtcaactgttctctaggtgttttatttagttgttatcagtatttcctttagttttcctacataacttttaaatgttaatggaattttttgcaattaataaaagaaactaaaataaaccaacaaattacaacatacatctttataacaattatttctaccaatattgatcttcttctgaaatttaactttatttaggccttaaaaacaaaaatgaaccaatgaaactgtcttggaccctctagaccagcccaggtgtcacctgaatagcaataaatgactctggtggatgccagcagagcagaactgcccagccaagcctgacctaaattcctaacccacaagatcatgaaatatgtttgctttttaagccactgtgttctgaaatgatttgttacgtggcaataagaagctgaatttttcattttaaacttcagtttgaaaattatgtatggcttatcaaagacatataggtgtctttgcttcaccatctcttcaactaaaccatcgaagcagtcagtatttcaaacactgacagtaactacaaaagaaaaaagctcagagggttttgctccagtccagaagtgacccatatgatttccacccacaattcactggacacagtcacatgggcctgtcaagcaggcttggagctgtgtaattccaccacatatccagaagggagagtgccagaactatttgacagacaacaccaatatctaccaccacagtatataattttaaataatatactaaagttagggaaaattttatccaaagaaaaacctgatacttcaaaaagagaagtgtcaattacaaactttcatatcaaaaaaagataagaaaggacaggtaaagttaaattgttaggccaattaatgtaataagaatccaggctttttctttgtgccaaatgtcaccataatctgttgtgaattagcagctagactcaaaatgtacaaacaataatttggggtgtccactttttaaaataataatatcactaaagtttctattcttgtaaataaaggcatatgtagggtttatacaaagctgtatacttaaaccatatgcaaataaccaaaaggcgctgaagtaaagtaacacgtgtatggctttggaactccaattccacctgtctcatcaagtgtactgacaaagcaaaagacccctatcttgtctatgtcaattaaatactaacatctgaaaaccaccactaaataagaaccaatagtcattacataagcaacagctaaaaattaacaaataattagaccagaagataatctaagattttgatacataactcaaggcagtatgatagacatcattagtggaaatccctcaaaggttagtcacaaatggtaatcttgatattaaatccgatagttttactattttaataagaattattatttatgagacatatttataataatggataggtattaacttagttattgttaacaattataatccattccactatagttagaactggcttaccaaattagaaaagggatataactatagttaatacatgtaaaaagctaaactgaaaaatcaacaactcttgctagaaccataaggtcaataaagtcacagggcaaacaggtaccctcagaactggaggaatagacatgaatcacaacttacctgagcagaaacccatgggtaaaaagctccatgggtacaaaaacctgaaccataattgacaaaacgttggaggttcagtgtggacgagtctggaagatacaaactacagagggacccagtcatcgtggggccccacggttttgtgttttacctctaggagctctaccagtttctcacagtgaacttcacagaaaaatatcttcttgctttcaacagcaggaggggaaaaggaaccatttctcttaacaaggcctgccttcaggagaaactatttaactagagcctaacctacgagaagagaaataaactccagccagttctagcctaagagaactatctaactttagcccattctaggccattctgccccacctaaaagcagtgaaagggcagggtggggaggaagagtaaaaaattcagacttccccctcctcctacaaggcccaccacattactacaggcctatttacagctgttgtctttacccagtgtactacacctggctatcgagaaaaaaaattacaaggtatactaaaaagcaaaaaacacagtatagagcaacatcagaactagacttggatgcaggaaggaatttgaaatgatcagatgaggaattgaaagcaactatgattaatatgctaacggttctaatggataaagtagacagcatgcaagaagacgtgggcaatgtaagcagagaactcgaaattctagagattaaaatgatagagatttttttaaaactaacagaaatgatgaatgcttttagtgggtctattagtagacctcacacagctgaggaaacaatctcattgcttgaagatatttcaaaagaaacttccaaacctgaaaagcaaagagaaaaagactgggaaaaaaaaaaaaaaaaagaacagaatgtttaatacagaaaactacaaaaaggtaacatgtaatggaaataccaaaaagagacaaaagagaggaagaagaagaaatattcctcaaattaatctcagaaaccaaatgacaaagaacatcaaaaaggataaatgcccaaacaaactacacctggtcacatcatattaaaaaccacagaatactgaaaaaacctaaaagaggtcagagggaaaaaaatacctaaggtaacaattacatcaactcagaaaccatgcaagcaagaaaagagggaatgaaatatgtaacatgttgagagaaagaaaacatcaacctagaattctgtaccctgcaaaattatccttcaaaagtgaaggctttctcaggcaaacaaaaatttaagaatttgttgtcagatgacctaccttgcaagaaatgttaaaagtccttcagagagaacaagaacggtacaggtcaaaaacttagacctatatcaagaaaggaagagcatctcagaaggggcaagtgaagataaaattttaaaaaaaaacttttttcttattaactgatctaatagataagtttgttcaaaataatatctgcaacaatgtattcaattatgattgcttatgtataaatacatatgcttatgtataactgaaatgactgacagcaacaatacaagggatgcgaggaaggaattaggattattttgttcttataaagtactcacattacaagtgaaaattacagtggtgccatcttatccatggggaatatattccaagaccccagcggatgcctgaaaccaaataacagcaaacccaatatatccagtatgctttttcaatcatactaagatggctactaagtgactaacaggcaggtagcatatacagtatggatgtgctggaccaagagatgattcacatctcaggctgaaaagcacaagatttcattatgctactgaaaacagcgtacaacttaaaatttatgaattgtttatttctggaatttcccatttagtattttcagaccacggttaactggaggtaaccaaaactgtgaaaagcaaaaccacagttaaagtgggacactactgcacagtgttattagaaagtagacttgggtttgttgtaaacatatattacaaactctaaggcaacaactcaaaaaaaaaaagagagaactgtgctaagaaagaagagaaaacagaatcatacaaattgctcaattaaaaccacaaaaggcaggctgggcatggtggctcacgcctgtaatcccagcactttgggaggccgaggcgggcagatcacaaggtcaggagatcgagaccatcctggctaacacagtgaaacaccgtctctactaaaaatattaaaaattagctgggcaggaaagcatgcgcctgtagtcccagctactcgggaggctgaggcaggagaatggcgtgaacccaggaggcggagcttgcaatgagccaagatgatgccactgcactccagcctgggcaacagagtgagactctgtctcaaaaaattataatacaataaaataaaatgaaaccacaaaaagcacaaaaagagtggaagacaaaaatatgaacaaagaacaaggacaataaatagaaaacagttaacagatatggtagatatccattccattatatcaacaatcactctaaagctgggcatggtggctcatcccagtaatcccaccactttaggaggctgaggccagcatttcaagaccagcctgggcaacacagcgagaacccgtccctccaaaaaaactattttttttttaattagccaggagtggtggtgtgcaccagtagtcccagctacttgggaggctgagcacaggtagtcccagctacttgcgaagctgaggtgcgaggatggcttgagcccaagagttcaaggttacagtgaaatatgatggcaccactgcactccaacctgggtgatacagtgagattctgtctctaaaaataaagaagaatcactttgagtaacaatggtctaaatataccaattaaaagacagaaattgttataataggttgtgtttgtttgtttgtttgttttgagacagagtcttgctctgtcgcccaggctggagtgcaatggcacgatctcagctcactgcaacctccacctcctggattcaagtgatttttgtgcctcagcctcctgagtagctgggacagtacccgccaccatgctcggttaatttttgtatttttaatagaggtggggtttcaccacgttggtcaggctggactcaaactcctgacctcaggcgatccacctgcctcagcctcctaaagtgctgtgattccaggtatgagccaccgcacatggcctagaatagattttttaaaaagaaaacccaagtacatattgtctacaaaaaaaccccactttaactataatataaagatacatacggataagaaataaatggatggagaaagatattccaggctaaaaataatcaaaagaaagcaggagtagctatattaatttcagacagctcagatgtcaaagttatcaggaataaagaaaggcattttataatgataaaggggttaattcccaagacatcagtgtgtctaaacagaacatcaaaatatgtgaagcaaaaaaatgatacaatctcaaggagtaagagatgaacccactattatcgttggaaagtttaacacccctctcagaaatagatctggcgtgcagaaaatcaacaaagacatagttgaatctgacaccgttaatcaactggaaataactgacatctaaagactacttcatcaacaatagcagaatacacatgcttctcatccacatgggacacttacaaggtagaccacattctgagccataaaacataccttaacagatttttaaaaatagaaatcatacaatgtctgctctcagatcacgtcagaattcaactagaattcggtaacagaaagatagcttaaaatcccaaaatactgagacattaaacaatacacttctaaataacacataggtcaaagaagaaatctcaagagaaattgaaaaatattttaaactaaatgaaaataaaaagaaaatttgtgagatgcagtgaaagcagtgcttagaggaaaagttatggcatttaacacatatacagttgacccttgaacaatgagagggttaggggctccaacccccccaccacacagtcaaaaatctgtgtaacttttgactccttgaaaacttaactactaatagcctactgttgacaggaagccttaccaataacataaacagtagattaacaaatatttctgtgttgtattatataccgtattcttacaataaagtaagctagagaaaagaaaatgttattaagaaaatcatggccaggcacagtggctcacacctgtaatcccagcactctgggaggccgaggcgggcggatcaggaggtcaggagataagagaccatcctggctaacacggtgaaaccccgtctctactaaagatacaaaaacttagctgggcgtggtggcatgtgcctataatcccagctcaggaggctgaggcaggagaatcgcttgaacccggaaggcagaggctgcagtgagccaagatcgtgccactgcactccagccagggagacaaggaaaaggaaaaggaaagaaaagaaaagaaaatcataaggaagagaaaatacatttacaagaccatactgtatttactgataccataagtttatgtcacctgtttacaagactgtctacctgaaatagtgggcaacctcagctacagacttccatctatggtacacatcaagcagttcaactttttcttgtatgtcatgactttgcttcttgtagggagcactttaagcatcattagtggcacttcatatgggtcccgtggtgttatgcacaatttatagcactgcactgaacatggtgaaagatacatgagaagcgccagatcactttttaccaagatacccaatttactggagagatgaactgctcaaagatgattggtatcccatggtgttttaatcagatatttgcaacacttgagttcactgcaataacaacaggaggtggccacataattattacagttgtacagtatgtactacagtaaattttattcagttattatttaatactacatctttacatttgtttacatttctctcaattgccaatggtaccacatacagtctttaagtgtgtgcttaagttttgataaattttaactttcagtaatagatttgtgtatattttatggtagtaaacaataaaacagacaagtatctacatatactttatgcattcatgcatacctttttcttaattttttaaatatttctaggctacacagtccatctacgcattttttcaaattgtcacgaatctccacgaaaaatttccaatatatttactgaaaaaaatccatttatcagtgcatgcacatggttcaaccccaagctattaaagggccaactgtttcagaaaggagggaaaatctacactcagtaatatcaaaaatgaaaaatgggacatcactacagatcccatggaatcttaaatattcaagaaatactattaacaactgtatgcccacaaatttgataacctagatgaaatggaccaattacttaaaagacacaatatgctcaagcttacacaagaagaaataatctgaatacgtctatacctattaaaacaaattgaatcaaaaattaataaacttcgaatattgaacacacccagtttggttcattgctgaattctaccaaacatttaaggaagaaattataccatttctctatactctctttcaggagataaagcatagggaaggccaggcatggtggctcacatctgtaatcctagcactttgggaggccgaggcaggtggatcacctgaggtcaggagttcgagatcagtctgaccaacatggtgaaaccccgtatcttctaaaaatacaaaaaaagtagccaggcatggtggcaggtgcctgtaatcccagctactgaggaggctgaggtaagagaatcgcctgaacccgggaggtggaggctgcagtgagccgagattgtgccattgtactccagcctgggcaacaaaagcaaaactctgtcttaaaaaaaaaaaaaaaaaaaaaaaaagaaagaaagaaagaaaaaaagcatagggaatacagacacctcaccaataaacataaacagatgggcagataagcatatgaacagatgttccacattatatgttatcagggaaatgaaaattaaaacaacagggcatcactacacacctattagaatggtcaaaatctggaacaccaacaccaccaaatgtcagtaagtacacagagcaacagaaacttttattcatttctagtgagaatgcaaaatggcacagccactttggaagacagcttggtggttccttacaaaactaaacatactcttgccatacaatccagaaatcatgctgcttggtatttatccaaatgagttgaaaacttacatccacaacaaaaattgcacatagatgttgacagaagctttcttaactgccaaaaccagggtgcaaatagaaattccatcagtaggcaaatggataaactctggtccatccaaacaatacaatattattcagcactaagaagaaatgcactatcaagacatgaaaagacacggaggagggctgggcgcggtgactcacgcctgtaatcccagcattttgggaggctgaggcgggtggatcacctgagatcaggagttcgagaccagcctgatcaacatggagaaaccccgtctctactaaaaatacaaaatagccaggtgtggtggtgcatgcctgtaataccagctactcgggaggctgagacgggagaatcacttgaaaccgggaggcggagactgcagtgggccaagatcacaccattgcactccagcctgggaatacagagcaagactccataaagaaagaaaagaaaagagaaaagaaaaaaacagaaaaggatgtggaggaaacataaatgcatattattaagtgaaagaagccagtctgaaaagactacatatcctatatgattcaaactatttgacactctggaaaaggcaaaactatggagacagtaaaaagaatagtggttgccataggttagcaaggagggagggagcaaggagggagggattaataggtggaacacctattaatttttagggcagtgactatgatactataatgacagatacctgtcattatacctttgtccaaacccatagaatgtaaaccaagagtgaacccttatgtgaactataaactgtggataatgtgtcaatgtaggcttaaaaaattgtgacaaatgtaccactctagtataggatgttgatactgaaaaaggctatgcacgtgtcggggaaggggatttatgggagatttcagtaccttcctcacaattttgctacaaacctaaaattgctctgaaaaataaaggctatttttggccaggtgcagtggttcatgcctataatcgcaacactttgggaagctgaggtgggcggatcacctgaggtcaggagttcaagaccagcctgaccaacatggaaaaccctgtctctactaaaaatacaaaatcagctgggcgtggtggcacatgcctgtagtcccagctactcgggaggctgaggcaggagaatcgcttgaacccaggaggcagaagttgcagtgagccgagattgcaccattgcactccagcttgggcaagaagagtgaaactctgtctcaaaaaaaataaataaataaaataaagtctatttttaaaaacttatgctagaagtaactgaatgtatcgatgtgaactcacatttgtaagtgtgtgtatagatctatgtaattacagtcctctcagaacagggatatgttctgaaatattcatcattaggcaattttgtcactgttacacaaacctagatggtatagcctactaaaaacctaggctatttggtacagcctagtactctaggctacaaacctgtacagcatgttactgtacgcaactataacacaacagtcaagtatttgtgtatctaaatatatgtaaacatagaaacaatggtaagaatacagtgtaaaaacacaaaaaatggtacacctacatagagcacttaccatgaatggtgcttgtgggactagaagttgctctgggtgaatcactgagtgaatgtaaaggcctcaaacattactatgcactaaagtaggctttataaacactgtacacttaggctacaccaaatttttaaaatattatttttctttgctcagtaataaattaaccttagcttactgtaacatttttactttataaactttttttaaactttttgacacttttgtaataacacagcttaaaacacacactgtacagctatacaaaaaaaatcttcctttctacccttattctgtaagttttttggttttagggtttttcttttttgtttctctgtttttgttttaaacttagcccaggcctacacgaagtcgggatcgtcactatcactgtctttccacctccacattttgccctgctggaaggtcttcagcgacaataacacacaaggagctgtcatttcgtatgataacaatgccttcttctgatatagctcctgaaggttctgcctgaggctgttttacagcttttttgcttaagaaaaggggtacactccaaaataatgataaaaagtatagtatagtaaatatataaaccagtaacacagtcacttattatcaagagttatgtactgtgcaagagtgtatgtagtgtacttttgtatagtacatgtaattgggagtacactgggtttgtttacaccagcatcaccacaaacatgtgagtaatgcactatgttgcgctgtgctatgacatcacgacagctatgacatcatgacagctatgacatattgaggtgacagaaatttctccgctccattataattttatgggactactgtcatatatgtgatctgctgtcattatgcagtgcatgactgtactagtatatgactaaagtggactcacataactaattctcaacagtaacaattgtaatatgcatccctttgttgtgggaagtcagggaccccaaactgagggaccggctgaagccatggtggaagaaataaattgtgaagatttcacagacatttattagagccccaaaataatacttttataatttcttacgcctgtctttactgtaatctctgaacataaattgtgaagatttcatgggcacttatcacttccccaatcaatacccttgtgatttcctatgcctgtctttactttaatctcttaatcccgtcattttcataagctgaggaggatgtatgtcgcctcaggaccctgtgatgattgcattaactgcacaaattgtttgcagagcatgtgtgtttgaactatatgaaatctgagcaccttgaaaaaagaacaggataacagcaatgttcagggaacaagagagacaaccttgaactctgaccgctggtgagccgggcagaacagagccacatttctcttctttcaaaagcaaatggaagaaatatcgctgaattctttttctcagcaaggaacatccctaagaaagcaaatgcatccctgagggtgggcctctaaaatggcccccttgggtgcggctgtcttttatggtcgagctgtagggatgaaataagtcccagtctcccgtagcgctcccaggcttattaggaagaggatatccccgcctaataaatttttggtcagaccagttgtctgctctcaaactgtctcctgataagatgttatcaattacaatgcgtgcccgaaacttcattaccaattttaatttcgccctggtcctgtggtcctgtgatctcgccctgccttcatttgccttgtgatattctattaccttgtgaagcacgtgatctctgtgacccacaccctattcatatactccctcccctttgaaaatcactaataaaaacttgctggttttgcggcctgtggggcatcacggaacctaccaacatgtgatgtctcccccggatgcccagctttaaaatttctctcctttgtactctgtccctctatttctcaaaccagccgaagcttagggaaaatagaaaagaacctacgtgaattatcgggggtgaattttgcccaatatctggctgaatttcccccgatatcccttgagcctaaatttttgtccctaatactattctccactaaaaaactagaagtccttagagaatagctgatttcataccttgtggcagggagaattttaaatgggcctgaaaaataaaacttttgccaaagagcacagagctctgaaaggttttgagatgttatttaaaaggactcagaagccagctgacaaggggctcccatgagccaaactatgacaacttgaacactaggagaaaaatgtttaattataactaactgaattataattagctaattatagttaatgaaaacaagtttgcaaagacctgattatgtgattctcaagaaaaaaaaagtttctcttctcttcaagtaactagcacttcactcaagttgattttattcatataaaaaaaatgcgcagagactggtaacagccaccaccaacaaaagatcaaattttctcagctgggtgtggtggctcatgcccgtaatcccaccactttgggatgccaaggcaggtggatcacgaggtcaggagttcaagaccagcctggcaaagatggtgaaacccagtctgcactaaaaatacaaaaaaattagccaggcatggtggcaggcacctataatcccagctactcgggaggctgaggcagagaattgcttgaacccgggaggcagaggttgcagtgagctgagataaagatgaaattttcttaacataaaatattaccaaatgaggtttcttattactttcccaatggctactcctagattactcattcccatccacccaccatggtaggagactcattagcattcttttcttttttctgagacaggatctcactctgttacccagactggtgaacagtggtgcgactgattacaggtcactgcaactggtgtctcccgggctcaagcgatcctcccacctcagcctcctgagtagctaggactacaggtgcacaccatcacacccaactaatttttgtatttttttgtagagacgggtttttgccatgttgcccaggctggtctccaactcctgagctcaagcaatccacccacctaggcctcccaaaggtctagggttataggtgtgagccaccacgcccagcgtaatacccttatattactacaaaacattaagtaagcatgtcaaggcacaggatttacaggaacaagagaaccttcaaataaaccctggggtcttgagacatacatatgttaaaaccttgcagcaaacttgaatgtgcttttaaatgaactagaaatttatggaacaaactctgtctggatttgcaggtttagtggttataacagttattctttctttcactgttctccttgccctatgttcactatgttccctaaaagaagtggacaatggactttccaaggacaaagacaaaacaaagactaatatacacttggctttattaactttagtaaagccaggttaaaaaaaatagttttctgctcctattaaaacatttatctaaactgtatttgccttgacctctcataggagacagcatgagaagacagtccattcgtggggcttactactctccagtaaggaaaaaaaaatgccaggaatttagttttgttgtaatgttgtaatgttccaagaatggtaggtagcttagaaaacataaagaaaattcaagaacacaatactgcttcacttagtgaatccaattcctcctatatccctagaagtattcttggcactggggataaataaggtaacaagacaaatcccctgacttcataaagcttacattctagtgtggaaagcatacaataagccaatatgaaattaaatgtcctatctgttacgtactaggagaaaaataaagcaggagaagacaaagtgacaagtgttactttttagacaagtttgtcaggaaaggtctctgggaaaactgtaactgagtagagacttgactgaagtaagggaataagctgtatgaatatctgagaaaaaatttttccaagcaaagaagacaaaaagtgcaaatgcctgagaaaggagtatgtttggtgggctcctggaaaagccaggaggccagtaaggatggagcccagtgaacaagggaacataagatacggttatacaagtagccaaagtcagatcaatggagcctgaaaacaatggtactgcatgaactttgaattttattctaaatatcactggagtctttggatggttgacagagggaagtaaaaggctctcactttgaatttggaaggatcactctggctactatgtgtgggacaagagtagaatggaatgaaaaggaaaaagaccagttaggaagctattgcagcagtccagtggaatggtagtgtgaagttctggaataatagcagtggaggggtcaaagtaattgaatccaggatatactgggtaggtaaagccctccagtgggctggatgtctaaaatgtgaaaatgtgaaatgtgaatgtctaaaatgtgaatgtataaaatgtaaaatgtgaaaatgtgaaatcaagaaagactccatctttttaagcctgaacaatatacagtggcaatataccagaggtggtaacactggaagagagggtttcaggataacaacaaaaatttccagagaggacacactaaatatgagatcctcttcagacatctaagaagagatgttaagaaacaagctgaaagatacaggttgtgttcaaagcaagaaagagctggtgacgtaattttagagtcattagcatttagataacataataatagcacaaaaatagataataagccattaaactgaataagaccacctaatacataagaagatgagcgaagagaatgagaaaaaaccagtgaaggagtaggaaaaaacaaaaaaacaaacaaacaaacaaaaaaaaaccaagacaatgcagtgacctgaaagtcaagttttaaaaaaaagtttcactcctgagagtggttagctgtgtgaaatgatcctgaaaggttaaggaggatgaagactaaaagctggtctgggcaatatgagatcattacattgacaagaataattttagtagaatgggaggaagaaagcttcattagagtgggttcatgagaaaatggtgaaaaataagtagtaatcataggtataaataactcaaggatttttgctatgatggagcaaagaagctgtatagtacctaaaaggggatgttggatcaagagaggctatttgtgttgaaagggggtgattctgcagcaccccccttatgctaatgaaatcaatgagatggaaaagttattgatgcagaaaagcaaggacaactgcagaaccaaagtccgtaatacatgagaggggacacaatggaagacacaagcagaggagctggctttatccgcagtctttatcccattttaccaggacagaaacaacatacgggtagggatgcaagcaagaaaatagatttgatggtagatgaatatggaacttcttttctaattgttctctattttttattttttcactgaaataagcaagatcatcactaaagaatcaaaaatgagaaggggtgttggaagtttcaggagaaaagaaaaggtggtgaaataatcatcttcaataatcaaagggccgggcatagtggctcacgcctgtaatcctagcattttgggaggccaaggtgggcggatcacgtgagatcaggagttcgaggccagcctggcaaacactgggagaaccctgtgtctactaaaaatacaaaaattagccgggcgtggtggcgggtggctgtaatcccagctactcagaaggctgagacaggagaatcacttgaacctgggaggcggaggttgcagtgagccaagatcacgccactgcactccagcctggggaacaaaggacgaaactctgtctcaaaaaaacaaaattaaaaaaaataataatcaggcacggcgcggtgactcacgcctgtaatctcagcactttgggagggcaaggcaggtggatcacgaggtcaggagttcaagaccagcctggccaatatggtgaaaccccatctctactaaaaaatacaaaaattagcgaggcgtggtggcatccacctatagtcccagaccaggagggagactgaggcaggagaatcactggaacccgggagacagagattgcagtgagctgagatcgcaccactgcactccagcctgggagacaagagtgagactccaactcaaaaagaataataataataataataataataataataataatagcaataataataattagagccagacacggtggctcacacctgtaatcccagcactttgggaggtgggtggatcacctgaggtcaggagttcgagaccagcctcgtcaacatggcaaaaccctgtctctactaaaaatacgagttatccaggcatggtggcgcatgtctataatcccagctacttgggaggctgaggcagggagaactgcatgagcccggcgggtggaggttgcagtgagccgagatcacaccactgtagtccagcctgggagagagagcaagactctgtctcaaaaataacaacaataggccaggcacagtggctcacgcctgtaatcccagcactttgggaggctgaggtgagcggattatgaggtcaggagattgagaccatcctggctaacacggtgaaaccccgtctctactaaagatacaaaaaattagctgggtgtggtggcgggcgcctgtagtctcagctattaaggaggctgacgcaggagaatggcatgaacctgtgaatccaggaggcagagcttgcagtgagctgagatcacgccactgcactccagcccaggcaacagagcaagactcttgtcttaaaaacaaacaaacaaacaaacaaaaacactaaagcttcaaaaagacttttcagtagtaaaagtaacaatatatagtacagaaaaaaaaaccatatgaaaaagaattaacagtttaaagtaatacagtaattcatgaatgtgcacaaaagggtgaaatttagtattctgagcttccaagagtaatactctaactagaccttattggaaagaaactatagattatttgaaggctttccaagaattatacctatataatagcaacacatctgacaactgtaaggatttctggaaaaatgtattttaaaatctataacaatttttaatttttctcatctcttaactgcatgatattctgtaagcatcaagatgatattcaacttcagagaaaaagcctatcactgtgtctaaactttatctaacaactattgaaaactttaccaatgagagactatctcctacaggtatcctctcaatacaatatgaatcctagtccctttgataacttaccactgacctgaaaattttggaaactgctttgggcaaccaactctagctaccttttgcagatgcacaacatacagcagcttatttaagggcacctaaaagtccaacagaccagaaactatttggtctagtttggcctagcctttcacaatattaattccataacgaaacatactacttttttcagaacacatattaacaaaataagctttaaacaaacactagatggttcataggccagaatatactatgagcgattatactaacagcctggattactgtttctcccagtctttatttccttgataaaacatttatcttcagatataaaataattatactaaaccagggcttagggaaaaaagagagatagagggctcagttttttcactttgtcattagttatcaaaacaaggcagatgggaaacttagagttcagtataaaaacaaatgcttaacacagaatattgttatacaaatgctacatgcagtgtacaaacatatgcaaagcatcattatacattcttataaattcttgagttctgatacctgtttccacaatcgtttctgtttctgttgtctccagcccatccatgctgtcctcatcttccactgcagttttccccctacttcgaggtctacagaaaaaaaaaaaaataataagtacatagagttaaatgttaaattttaaggcttagacttatattcaacataaggcacaatttgaaggtatacaaaataagtaattagggcatttttccagcattttaccatatcaagtagaaaatatcagagtttacagtcattttctcccttaaatccagcacttccttatactctaaatgtgaggacagacccacatgaatataattgtgtcctcataattcacttaagtattcctcactctggttttgccccttttttaggtaaccttctgaagtctccctctgtctacagtagtggcttttaactacataatgggttcttcacaaagttcacataccaggtttaacttctatatttaataaagttgatgtgaaatgaccagatatatgtatttttaaaagctttgtaaaaggtgcttttggtgactgtgatgcagatgactaaaaaacaaaattttaaaaattaagcacgattataatcatgtccaccttacaagcataataaaatttaatttataaacacttcaggaaagtaaaataaaggtaagagtcacagcaaggtgaaattcctgacagaaagcaattgaaaaaaaaaaaaaaaactaatgcctttaaattctttgaattgtactaaatacggtatagaaatgagtaaaagaaaaattaataacacataagagcaacaagatattacacataaaaacttggaaactgacaaagcagtactcagataatgtcagtgttttaaattatttcgcagtattttaaactctttaaaagaaaaaggctgggtaaggtggctcacacctgtaaccccagcactttggagggtcgagttagatggatcatttgagtgcaagagttcaagaccagcctggccatcatggcgaaaccccatctctaccaaaaaaaaaattcaaaaattaggcaaacatggtggcgtgccagtaattccagctaaagaaaaaaaacaaagaagggagggagggaggaaatagaaagaaaaaatacaaatcaactcagtatttaattgaaaaacataaaacatttaaaaagtgaaaaacagctggctgtggtggctcacatctgtaatcccagcactttgggaggctgaggcagatatatcacctgaggtcaggaggtcacgaacagcctggccaacatggtgaaactccgtctctactaaaaatacaaaaattagccaggtgttgtggcgtgtgcctgtaatcccagctacttgggaggctgaggcacaagaatcgcttgaacctgacagatggaggttgcagtgagctgatatcatgccactgcactccagcctgggcgacagagtgagactgtctcaaacacacaaacaaaaaaaaggggggtggggggggggggacaatatgaaataaaagaataatatgaaaaaagaataaaacaaagaactatgttttaaacaataagaaatccatttaagtcttgttctcataaaaaagttaaccaacctaggccaggcacagtaactcacgcctgtaatcctagtactttgggaggccgaggtgggtggatcacctgaggtcaggagttcaagaccagcctggcctacgtggcgaaacctcgtctctactaaaaatacaaaaattagctggacgtgttgatgcacatctgtaatcccagctactcaggaggctgaggcaggagaatcgcttgaacccagtgggcaggaggtgcagtgagccgagatcacaccattgcactccagcctgggcaacaagagtgaaactctgtctcaaaaaaaaaaagttaaccaacctaaaccatgaaggagctataacataataatatattaaaaattaaggtgaccagccgggcgtagtggctcacacctgtaatcccagcactctgagaggccgaggcaggcagatcacctgaggtagggagttcgagaccagcctgaccaacatggagaaaccccgtcactactaaaaaaaatacaaaaacaaaaagaaaaattagctgggcatggtggcacatgcctgtaatcccagctactcgagaggctaaggcaggagaattgcttgaacctgggaggcagaagttgcggtgagccgagattgcaccactgcactccagcctgggcaacaagggcgaaattctatctcaaaaagaaaaaaaaattgaagtaatcaaagcctaaatggttttataattaaactactaaaaactatcaaaaagtcggtcttaaccaaaaataaaaaaaaggaagtacctgactcagaattccaacaaacattgtcaaaaactatgaatgaaaataaaaactgagaacaatcctattgaatataatcagaatgccaggatgattcaacattagaaatttgttaatgttacataacaagtcaagcagtcaaaatagcatcacttcaaacttcacagggggaaaggggaaagaaggcagaactaaataaaaagactacaaaacctgaaagatgaaaaagggtgaattagggagaaaacactctaaggtggatcttattgttcatggacaaaaagaaagaacatctttagaatttattaagtagttgtttttaggctgggcacggtggctcacgcctgtaatcccagcactttgggaggctgaggtgggtggatcacgaggtcaggagatcgagaccatcctggctaacacggtgaaaccccgtctctactaaaaatatacaaaaaaattagccgggcgtggtagtgggcgcctgtagtcccagctactcgggaggctgaggcaggagaatggcgtgaacccgggaggcagaggttgcggtgagctgagatcacaccattgcactccagcctgggcaacaagagagaaactccgtctcaaaaaaaaagaatttattaagtagttgtttttaaatttgatagaaaacattaaaataaagtggaaagaagggataagaaaatttgatcaatccaacagcaggcagaaaaggaatgaaaacaaatggtacatagaaaataacataaaaagataaatataaatatgaattttcacagtaaacataaatggcttaaactgtcataatgataaaaaaattaatttacttggataacataagagaacttcagattacataaagcaaacatttacagaacaaagagaaattggtaactaatcattagagagatattaacatcccactgtcggaaactgatagatgaaacattatagtttgaagcattttaaacaagtatttggacaacacattgagcaagcattactagattactctatcaatcttcctttgtgtctgactctgttcaaacacagtggatacagaaataaataaaacaaaatccctcctgtcacaaaactacattctagtgagaagagacaacagtaaacaagtattacacatacaacatccaacaaaagaaagcaaagaaaaagggactagctattttaaataacagatttataaaataaatgttttaaaataaaattttgtaaggagccactttagcacagaactgaagatgaagcaaaccatacagatatctgggagaaaagcattgcagtagaagtaacagcaaatgcaaaattcttgagatgagagcaagtgaggggggttagagggacaagaaggatatacggtggctggggcagagtcagcggtagggggtaagaaggcatgaggtctaagaatttttttttaataggatcactttttgtttagaaacctgtagaccaatacaagaactggggactgggagactagaaatcctcgaaacaatcccaacatggctgcttcaaagaaaatagagaatgacaaaataattcacatgccattatggaggtagagtttacttttcatctttcttttgtgatttttcataatcataaacatccacttttaaagaaattggaaaccgtatggtttagctgactttttaacttaatctctcagacccatgttttgctctactttgagttttttctccactatcttgaccatcactgtctatgctgttgtttgttttggcacaactggctttatttcaagctcgttctgtctagtttataatctctatcaacatatcagttatctgcattgccctacttactccttaaaaaataattttgattttaatttttgcttttcaaatttttcttctgatttctattcttggttttggcactaggaagacatgctttttacgttgatcaattcatcagaattcctttccttctgggcaatggaccaacttattgacatcatgtcattttcgaattcttttatttcatcggtgtccttattgctgctcattggcttctgccatgtgacttttctgactaatcaaacactatattctgaatgcaaagataatggtcatactcttcaaaaccctatcagttgccaactttcatatttaaacagcaaaatagatacatgttttatatttccatattgagtcagatatttccagtttcagtttttaaggaaagtttgaagtctaattacaaatgacaacatgaagattatttattttaacccttctttgggttttcttcgttcccctctttttcctgtctcttaaccctttcatttcagtgttcttcacttcactttattaccaagaaatgtgaagtaaaagaatacaactaactttatttgagaaaattttctaccaaaactttatgttccatattaatctcagaatctgaaaccaacttgagttcctaaagtaacataggagacttctacataaagccacatgggagtaagacaggtcaaaattaccctccagcccaaacaactaggaaaccagacaaatataagaaacaaccttattataagacactgggcaacaggtatggcgaagggaacaaagggaaagaaacagggtgacccctaccatggcacaggctttctgcttggcattaatttagaaactaccacacagagataggaacccaaaatgagagctgaaatgagaagacagaaatcataggttcaggtggctcaagaagactagaatttgtgggacagactacccaagagaagagaggtattcagagaaagagctccagaaatctgcagagggatacccttgagtttcaactgaataccaatctgcacatgtgtgatgtgaaatcccagaagactgaacaagaacaacttccagggagagagcaattacagaagaacaattcccagagctcacagaaagctgcgaatcaactgtattgtctctagccaactgtattgtctttagccagagtggcaagacctcaatgactatgtaacacattcagcagagaccagagtgagacacacctttaggagcagggctaaatgagccacagaacaaatgctattctagaccatccctaaaagagctgacaaataagtctcaacttatcctgagagtgactctgtatgaaaaaaataaataagtctcaactgaacaataatgattcccaacttaactactgggcataatccaataatccagctattataagtatgcctcatatgcgcaagaatgtaaagaaaacatgaatatgagagaaacagaagatattaaaaataacatggaactcaaaggtaacatcaaaagataacatcaaatgtaaatttcaggccgggtgtggtggctcacgcctctaatcccagcactttgggaggctgaggcgggcagatcacaaggtcaggagatcgagaccatcctggctaacatggtgaaaccccatctctactaaaaatacaaaaaattagccgggcgcgtggtggcaggtgcctgtagtcctagctatttgggaggctgaggcaggagaatggtgtgaacccaggaggtggagactgcagtgagccgagattacaccactgcactccagcctgggtgacagagcgagactccgtctccaaaaaaaaaaagaaaagaaaaaaagaaaaaaatgcaaatttcacattgaaaagttaacatgtgattagaaatgacaaaagaagatcattatccctaaagacataacaaaaaaaaatctattcaaaataaagaacagtatgaaaaatgacaacacagctacagtgccctgtggaataatagcaacctacctaactaatatgtgtgaggttggggttaaagggatagggacaaaaaaattgtttagtgaaataattagctgtaaattttaaaagctgtattattataagcccacagatccaagcacaacaaaatctgaaacagacagacacacacacacacacacacacacacacacacacacgtaccagtaaggtactttatagtcaaattgctgaaaaagattaataaagagaaaatattaaaagcagcaaaagaaaatacacattgcttaaagggggaataaagtaaaaatgactgcaggcttcttgtctgaaactatgtaagccagaagacagtaaaaaacatatttaaagtactaaggagaaaattaaaggaaaaacccttctaaacactgaacaaaacatgcagcaaaaaaaagtatccttcaaaagcaacagtaggctgggtgcagtggctcacgcctataatcccagcactttgggaagccgaggcaggcggatcacctgaggtcgagttcgagaccagcctggccaagatggtgaaaccctgtctctgctaaaaatacaaaaatcagccaggaatggtagcaggcgcctgtaatcccagctactctggaggctgaggcagaattgctccaactagggaggtggaggttgcagtgagcagaaatcgcaccgctgcactccagcctgggcggcagagtgagaccctgtctcaaacaaacaaacaaacaaacaaacagttaactaaaaacttcctccttttttcttttcttcttttgagatggagtctcgctatattgctcaggcaggtcttgaattcctggtctcaagcgatcctcccaccttggcttcccatagggctgggattacaggcattagcctcccggcccagtgttttgttttgaagtgtgctttgtctgatattaacatagccactccagcttaatttgattagtgttggcatgttttatctttctctttatgtcattttatttcaattgtctttcaggtagacagaatataattaggtctaaaatagattctattagtggggcatagtggcatgtgcctgtagtcctgggtactcaggaggatgaggtgggacgaacacctgacaaaaacaacccaactcaaaaatgagcaaagaacttccacagacattttccaaagaagttatacaaatgaccaaaaaaacatgaaaagatgctcacgatgactattagaaaaatgaaaaatcaaaactaagatataccacctcacacccattaggatggctactgtgaaaaataaaaaaaagaataacaaatgttggcaaggacgtggagaaactgaaacactagtgcacaggtgtagggaacataaaatgatatgggccctggaaaacagtacggcagtttctcaagcagttaaaaatagaattgccatatgatccacaaattccacctctgggtatacaccaaaaagaatcagaagcagagtctccaaagagatatttatacacccatgttcacagcagcattattcacaataaataaaacataattaacagttaagtaaaatgtggtacagacataccacattggcagtatgtctatggtggaatactatgcagccttaaaaaggaaggaatttctgacatatgcgatactacaacataaatgaaccttgacaacaatctcctaagtgaattaaaccagtcacaaagaaaaaaaaatagtggatgattccacttatataaggtactaagagtagctaaaatcagagacggaaagtggaacggtggttgccagaggctgagagaagggagaaactgggagttattgtttaatggctataaagtatgagtttaacaagattttttaaaaagctatgaaaatggatagtgtctacattatgaatgtatctcacatcactaaaatgtacacttaaaaatagttaaggggttgggtggccacagacggccgggcgggatgtaaccagccgctgagctgcagcccttccgtgtccgcaggcttcggcccggccgccgccgcccatcagctatggaggagctttacaacttcccggcctgcagagccgggcgcagcaagggccagacgcggcgcgagctggcgctgcgagccaacgggccggcgcctggcgggcacgatcgcaaggtcgcgcagaagctcctcaatggccagcgccagttgcagccccggccgcacccttgcctcacctgagcctgggctcttgctcttgcggaatccacaggtctttcttgaagaaatctgtagtcagaactctgtgctgcatttttatccagagaaggaacaggaagagaagagtgtggtctcctagaaatctagcactggagaaacgaggaaaattcttccaaggatggtctcccactcagagctgaggaagcttttctactcagcagatgcagtgtgttttgatgttgacagcacggtcatcagagaagaaggaaccaacattcaaagcagctgccaactattccaagtttcccagctggaggagccctgacctgcaccttcgcagaagccctgaagcagacaccccagggagcacctaccaggggcacccccggctggcaccagcatacaaagtgagacagggtctcgccttatttcgcaggctggtctggaactcctgagctcaaacaatctacccacctcggcctcccaaagttctgggattacaggtgtgagccaccttacccagagaggcgaacctggattgggaaagtcgacattaatcaactcattattccttacagatttgtatgctccagagtatccaggtccttctcatagaattaaaaagactatacaggtggacaatccaaagttttaatcaaagaaggtggtgttcagttgctgctcacaatagctgacaccccaggatttggagatgtagtggataatagtaattgctggcagcctcttatcgattacattgatagtaaatctgaggactacctaaatgcagaatcacgagtgaacagacgtcagatgcctaatagcagggtgcagtgttgtttatacttcattgctccttcaggacatgaacttaaaccattggatattgagtttatgaagcgttcgcatgaaaaagtgattatcatccaacttattgccaaagcagacacacttataccagaggaatgccaacagtttaaaaaacagataatgaaagaaatccaagaacataaaattaagatatatgattttccagaaatagatgatgaagaagaaaataaacttgctaaaaaggtaaaggactgtttacctcttgctgtggtaagctagtaatactatcattgaagttaatggcaaaagggtcaaaggaaggcagtatccttggggtgctgctgaagttgaaaatggtgaacattgtgattttacaattctaagaaatatgctgataaaaacacacactcaggacttgaaagatgttactaataatgtccactatgagaactacagaagcagaaaactggcagctgtgacttataatggagttgataacaacaagaataaagggcagctgactaagagccctctggcacaaatggaagaagaaagaagggagtatgcagctaaaatgaagaagatagagatggagatggagcaggtgttagagatgaaggtcaaataaaaagttcaaaaactaaaggactctgaagctgagctccagtggcgccgtgagctaatgaaaaagaatttggaagcacagcacaaagaattagaggaaaaacgtcgtcagtttgaggatgagaaggcaaactgggaagctcaacaacatattttagaacagaactcttcgagaaccttggaaaagaacaagaagaaagggaagatcttttaaactctctattgaccaccagttacgtattagttgccaatatgccagcttggacatcagtgtttgttggatccgtttgaccaatatgcaccagtttcatccataatgatggatttaacagcgtgacaaaaattattttttcttgtttttcttgatggagattaagatgccttgaattgtctagggtgttgtgtacttagaaagtaacagctctaagtacctttcctacattttctttttcttttttttattaaacagatatcttcagtttaatacaggagaacattttactgttgtacaatcatgttctcgtggtttgattgtttacagcctattccaaaataaaaggactgtggaaggttaaaaaaaaaaaatagttaagggccaggagcagtggctcacacctgtaatcccagcactttggaaggccaaggcaggcagatcacttgaggtcaggagttcgagaccagcctggccaacatggcaaaatcctgtctccactaaaaatacaaaagttggccgggcatggtggcacgtgcctgtaatcccagttacttgggaggctgaggcaggagaatcacttgaacctgggaagcagagactgcagtgaaccaagatcacgccaccacactccagcctgggcaacagagtgaggccctgtctcaaaaaaaaacaaaaacaaaaaaaaaaacaagatggcaaattatattttgtgtatattctaccacaactttttaaaaactcaaatcaaaatctgactgtttgtaaagatcaataaaattgacaagattccagcaaaactaacacacacaaaaaaatgactactatggtttgaatatcatttgtcctcaccaaatctcatgttgaagcttggtctgcaatgtagcagtgttgagaggtggtacctttaagaggtgattaggttgttaagagggattaatgtcgttctgaaaggagttctcactcttggagaagtgaacccacaagagtaggttgttataaagtgaggatgcctctcatgtttggcctctctttgcaaacatgtgcttccccttgcacttctctgccatgttatgacacagcacaaagccctcaccacatgcggcaacccatcttagatttctcagcctccagaaccataaaccaaataaatctttttcctttataaactaccaactctcgggtattttgctatagcaatagaaaatgaactaaaacaggaatgaaaggggatttcactatagactccacagacattaaaatgacaataaggttgggtgcggtggctcatgcctgtaatcccagcgggcagatcatgaggtcaggagatcgagaccatcctggctaacacggtgaaaccccgtctctactaaaaatacaaaaaaattagctgggcgtggtagtgggcacctgtagtctcagctactcaggaggctgaggcaggagaatggcgtgaaccctggaggcagagcttgcagtgagccgagatcacacaactgcactccagcctggacaacggagggagactccgtctcaaaaaaaaaaaaagaagacaataaaagagcagtatgaacaactccacacacataagtttgatatctttaaatgaaatggaccaattcataggaaatgacaaactaccaaaactcacccaagatgaaatatgtaacctgaacagctctgtaactattaaagaaattgaatttatagtatgaaattttctgaaataacaatctccaggcccaggtgctttcactaactaatttctaaccaacactttaagatgatgtaacaccaactctacagaatcccttccagaaaaaggagggaacaacatttctccactcatttaatgaggtcagcattatcctaaagccaaaatcaggcaaagacagtacaaagaagcaaaactaaagaccaatttcctaagtgaacataaacacaaaaatcatcaagaatatattagcaaatcaaactcaggaacataagaagagtaatataccacaccatgtagggtttatcccaggaatgctacacttgttcaatattcaaaaaatcaatcaatgtaatctaccatgttagaagtctaaatcactggtcagcaaactacggtccagaggccaaatccagtcctgtacttggtctttgtaataattttatcggaacatagccatgtatatttgtttacatacagtctacatctgctttcatgctacaatagcagatatcagcagttacaacagacagcatattgccagcaaagcctaaaatatttactatgtgaccccttacagaaaaaaatgtgggaggtcaccaccattagacctgccttacaagaaatgctaaagaaagttcttcaaattgaaacaaaagaactctaaaaacataaaaacatattaaagaataaaactcactataaagataacaatatattcaaattcagaatactccaatactgtaatggtggtacctaaatcagatttaagtctagtataaatgtaaagagacaaaagtattaaatattaactatacatacaacaatttggtaatggatacatgatatataaaagatatacattatgaaatcaataatacaaaatgtgaaaggagacgttaaatgtaaagttgtggtatactgttgaggttgtcagcttaaaatagactattaacactataagatgttttatgtaagcttcatggtaaccacaaaaaaaaggctgtagtagatacataaaccagaaaagaaccaacgcatatcactatcaaaaaaatcatcaaatcacaaaggaagacagcaagagaggaagactgaaacaaacaaacttacaagagtcagaaaaattgacaaaatggcgatagcatctccttgcctatcaataattattttaaatggaaataaatttaatactccagaagacacagattggctgagtgattttttttttaattttttcatttcattttattttttttgagatggagtctcgctctgtcacccaggctggagtgcagtggcatgatctcagctcactggaaaccccacctcccaggttcaagcagttctcccacctcagccacctgagtagctaggattacagacacatgccaccacacctggctaatttttgtatttttagtagacatggaatttcaccatattggccatgctggtctcgaattcctgacctcaggtgatccacctgccttggcctccctaagtgctggtattacaggtgtgagccaccgtgcctggccgagtggatttttaaaaacaagatccaatgatatgctgcctacaagatacatgaaacagaaaatcaaaagcatatcactaccaaaaaatcgtcaaatcacaaaggaagacggctagagaggaagactggaacaaagaaactacaagagtcagaaaaactgacaaaatggcagtagtaactccttacctatcaataattattttaaatgaaaagaattaagctctccaataagacacagattgaatggatttttgattgtttaagacggagtctcactctgtcgcccagactggactgcgatggtgtgatctcagctcaccgcaacctccacctcctgggttcaagcgattcacctgcctcagcctcctgagtaactgggattacaggcgcccaccaccacacccagctaatttttgtatttttagtaaagatggggtttcaccatgttggtcaggctggtctcaaactcctgacctcaggtgatctacccacctcagcctcccaaagtgctaggaatacaagcgtgagccactgcacccagccaagcggatttttaaaaacaagatccacctatatgctgcctacaagagactctctttagctttaaaggactgaggctgaaagtgaagagatggaaaaagatattccacacacatgttaaccaaagagagcagaggatccttacataaaataaaatagactttgagtcaaaaagtgttaaaagagatcagaggtcaattcatcaggagaatgtaacatttataaatatatatacatgccccaatttggagcacctaaatatataaagcactatcaatagaactaaagggggaaatagcaataccgtaatagtggggaacttaaataccccactttcgacaacggataaataatccagacaaaaattaataaggaaacacagacttgaacattacagactaaatggacctaacagacacatacagaacattctagccaacagcagctgaatatacattcttcttaagcagacacagaatattctccaggatagatcatatgttaggccacaaaacaagttttaacaaattcaagaagaatgaaatcatttcaagtatctttctaacaacaattgtatgaaactagaaatcaatgacataggaagaaagctagaaaattcataaagaaatcaaaagggaaaatctgttaatatggttgtcatatttacaaatcaaggaaaaatgatcatctcaacaaatgcagaaaaaaaacagatataaatgcagtaagacttctatgtccacgggttccgcatctgtaaatccaaatgactatggatcaaaaaaatattatttgtttattactgtctctttagctgtatactccatgaagactagaaatttgttctattcactgctgcacccccaacacctaacagcaccagatgaaacataagcactcaatatatgttttgttgaaagagtagatggttctataactcaggacaaaaatatggattcaataacaaatattgagataacagcctaacaattctgaaaagcaagttacagttctgtctcccactgaacaaaataataaaatttcacagggaatcaaactttaaaacaaagccacttaatactggatgttgtgtcattaagctaagtgataagaaataagacactttaataccataaaggaacaggctaaagtgtcataattagcagaaaatatcactaatgtctacttagaaaatacaagtttatcaactgaaatgttaaaagagttctttaagattgtcagatcaacacagtaacatataaacatcaataacttttctatacagcatacagtagaaataattattctactgtaatagaaagagatatcaacaacaaagttactaggaataactttaataagtaatataaaactctacttatgaacataaaggaagaataaagtatcctgagacacaaacctaattttttttaaaaagggacaaaggatatgaacaacaaattcatttttgaataagaaattcagacacaattaatcaacctatagaatatgataaagtgctcaactttaccaagtaatcagggaaatcgaacaatgatatgaaaaatgaaaactactggtcaggcctggtagctcaagcctataatcccagcactttgggaggccaaagcgggcagatcacttgaggccaggagttcaagaccagcctgaccaatatggtgaaaccccgagatctctactaaaaatacaaaaattagccaggcatggtggcacatgcctgtagtaccagctactcaggaggctgaggcacaagaatcacttgaacctggcaggtggaggttgcagtgacccgagattgcaccattgcactccagactgggcaagagagcaagactctgtctcaaaaaatagtaataataataataataattaataaaaattgaaaagaaattttaaaaataataatttttaaaatgagtgaatgagaaaaacaaattctcaatagaaaaataacaaatacagtccaacaactgaaagagtgaaagtctctgaacacatgagatattcaactaaacaattttagaaatggaaatgaaagcaaggagtatcatttcagataccaaattagcaaagagtgataacacactctgctagtcaggttatgggaaaatcgacactagtaggagtgtaaactgaacaatcaggccgggtgtgctggctcatgcctgtaatcccagcactttgggaagccaaggtgggtggatcacttaaggtcaggagttccagaccagcctggccaatatggtgaaactctgtccctactaaaaatacaaaaattagccaggcatggtggcacactcctgtaatcccagctacttggggtggcttgaacccgagaggcggagcttgcagtgagccgagatcgcagcattgtactctagccttagtgacacagggagactctgtctctcaaaaaaaaaaaaaaaaattgaagagaaaaacacaaggaaaaaaatccatgcaaaatcaatttttcagaactcctcgattaaaaaataatgtcaaacattaagaggaatatccattttgcttacagacatacctcattttatttcacgtcacagataataagttgtttgtttgtttggggacacagtctcactctgctgcccaaactggactgcagtggcacaatctcggcttactgcaacctccgcctcccaggttcaagtggttctcctgcctcagcctcatgagtagctgagactacaggcacgtgccaccacacccagctgattttttatttttagtagagacagggtttcaccatgctggccaggctggtctcaaactcctgacctcaggtgatctgcccacctcggcctcccaaagtgctgggattacaggcgtaagccaccacacccagcgagttttttttaaaatagcaaaggcttttgtcaaccttgcactgaacaagtctttttttttttgagacggagtcttgctctgtcgcccaggctggggtgcagtgggatgatcttggctcaatgaaacctctatctcccaggttcaagcaattcttctgcctcagtctcccaagtagctgggattacaggcgcccacaaccacgcccagctaatttttgtatttttagtagagacagggtttcaccatgctggccaggctggtctcaaactcctgacctcaggtgatccacccgcctcagcctcccaagtgctgggattacaggtgtgagccatagtacccagcctgaacaaatctactgacaccattttccagcagcatgcactcactttgtgtctctgtgttacgttttagtaatcctcaaagtattttgaactttttcattattattatatctgtgatagtgatctacgatcagtgatatatatatattttttcctttggttgagaaagggtcttgttctgtcacccaggctggagtgcagtggcacaatcacagctcactgcagcctcaaccttccggactcaagtgctcagcctcatcggtaggtgggacaacaggcatgtaccaccacacctggctgatttattttttatagagatggggtgtcaccatgttgctcaggctagtctcaaactcaagcgatcctcctgccttggcctcccaaagtgctgggattccaggagtgagctaccatgctatctttgatgttactattgtaattgttttggaacaccatgaaccacgcccacataagatggctaacatataatgtgtgttctgactgctccaccaattagccattccctatctctctttctccctcttttcagacctcccgtttccccaacacacaaccatattgaaattaggccaattagttaaccctaatcctacaatggcctcaaacaattcagggaaaggaaaagtcatgtgcctctcactttaactgaaaagctacaaatgattaatcttagtggggaaggcatatcaaaaagtgagaaaggcctaaggctagacctcttgtaccactcagccaattgtgaatgtaaatgaaaaattcttgaataaaattaaaagcactatgtcagtgaacatgaaacaatcttgttgctaatatgaagaaagttttagtggtccatatggaagattaaaccagccataacattcccttaagcaaaaagcctaatccacagcaaggctctaaccttcttcaattctatgaaggctgagagaggtgagaaaactgcagaagaaaaactggaagcaagtagagattggttcatgaggaaaaatgctctcgtcataacataaaagtggaaagtgaagcagcaagtgctgacatggaagctgtagcaagttatctagaatatctaactaagatcattgctggaggtggctatactaaacaaggtgttttatgtagacaaaagagccttccattagaagaagatgccatctaggactttcacagctagagagggaaaatcaatgccttgcttcaaaggtcaggctggggccacacctgttatcccagcactttgagaggccaaggtaggagaatcgcttgagcccaggagttcaaggccagcctgggcaacaaggcgagactcttgtctcttttaaaaataataaataaataaataaaaactgactctcttgttaggggctaatgcagctggtaacttgacgttgaagctaatgctcatttgccactcaaaaagtcctagagctcttaagaattatgctatatctaatctgcttgctgtctacatatggaacaacagtctcctggatgacagcacatctgtttagaggttggcttactgaatattttcagtccactgtcaagacctactgctaaggaaaaaacattcctttcaaaatattagcactcactaacaatggaccaggtcattcgagggctttgatggatatgttcagaaagaagaatgttactttcatgcctgccagtacgatacatctatcctgcagcccacgtatcaatgagtaatttcaatttttaagtcttactgtttaagaaatacatttcggccaggtacggtggctcatgcctgtaatcccagcactctgggatgccaaggcaggcggatcacttgaagccaggagttcaagaagaccctggccaacatggcaaaaccctatttctactaaaaatacaaaaataagccgggcgtggtggcacacacctgtagtcccagatactcgggggagctgagtcaggagaatcgcttgaaccaggaggcagaggttgcactaaaccaagatcgcaccactgcactccagccagggcgacaaagcgagactccgtctcaaaaaaaaaaaaaaaaaaaagtgattcctgtagtagatttgggcaaagtaaactgaaaaccttctggaaaggattcaccaccgtagatgtcattaagaacattcataattcatgagaggaagtcaaaatatcaacatgaacaggtgtctggaagaagttgattccaactctcatggataactttgaggggttcaagactcaagtggaggaagtcattgcagatgtagtggaaacagcaagagaattagaagtggagcctgaagatgtgactggattgctgcaatctcatgataaaacttgaacagattaggagttgttccttacagatgagccaagaaagtggtttcttaaagatggaatctactcctggtgaagaggctgtgaaattgttgaataacaacaaaggattcagaatactatataaccttagttgttaaagcagtgtttgagctgactccaattttgaaaaaagttctacttttgggtaaaaaatgctatcaaacagcatcacgtgctacagagaaatctttcatgaaagaaacaggcaatcaatgtagcaaacttcattgttgtcttattgtaagaaactaccagaggcaccccaaccttcagcaatcactgctgggatcagtcagcagccaccaacatcctctatcagcaaaaaatcttacaatttactgaaagctcagatgatcagtagcattttttagcaataaagtatttttaaattaaagtatgcacattggttttttaaatataacgctactgaacatttaatagactgcagtagaatataaacataatatttacatgcactggtaaaccaaaatatttgtgtgccttgctttatggtgatactcactttattgtggtagtctataatggaacctacagtatctccaaggtatgcctgtatttactttggtaccaattctagatatatatctgcatatacccaggtatttaacttcctggtctcatgttccttaaatagttaataagaaagagtaattatgaaccatgcagagcaattaacaagcctaacttccaatattttcttcactctgaagtaagtatttccaacagtgtattatgtcagaagttctcagttttgggggtgctgtatcttaatttttctgtactctattttcaacttcactgaaataatacaagctctatcttccttacaaatttataaggaatcaaatgaaatgaaatatataaaagttgtcctctttctcccatcttcaaaaaacttcccccgcacttcatttcctgttagccctctctccttcaacagcctggtctgtagaaagagtccatacatggcctccctccactccctcatcttccattcattccttgttccaaggccctcccaacaccactgaaacttttttcaatgccctttttttaaattattattatttttttaaaaagcaaattctgcccccatcttttcattctttcagttgaaccactttttccaaaacactgtgcagatataaaaaatacgtagttaaggccagggtgcagtggctcatgcctgtattcccagcacttcgggagtccaaggcaggcagaacacaggtctggagttcaagaccagcctggtcaacatggtgaaaccccatctctactaaatatacaaaaataagccaggcgtggtggtgggcacctgtaatcccagctactcaggaggctgaggcaggagaatcgcctgaacccagaaggtggaggttgcagtgagccgagatcatgccactgcactccagcctaggcgacagagtaagactctgtctccaaaaaacaaacaaacaaaaatggacaaaggagccaggcgtggtggtgcacacatagagccccagctactcagaggctgaagtaggaggatcacttgagctagaggatcacttgaccccaggagttcaaggctgcagtgagctagaactgtgccactgcaatccagcctgtgtgacagagtaagactccatcaaaaaagacaaggacaaagacatgacaagagagaaaaaataagtataaaagacagagagagagagacttcaaaaaggaggacagggcagggcacagtggcccatgcctgtaatcccagcactttaggaggctgtaatgggaggatcacttgagcccatgggttcgagaccagcctaggcaacacagcgagaccccagtatctacaaaaactagccgggaatggctgggcatggtggctcacacctgtaatcctaacactttgggaggccgaggcaggcggattgcctgagctcaggaattcgagaccagctgggtaacatggtgaaaccccatctctactaaaatataaaaacttagccaggggtggcagcatgtgcctgtagtcccagctacttgggaggctgaggcaggagaatcacttgaacccaggaggcagaagttgcagtgagctgagatcacaccactacactacttcactccaggatgggcaacagagcgagactccatctccaaaaaaaaaaacaaaacaaaacaaaaaacaaaacaaaaaaaactaggctgggcacagtggctcacacctataatcccagcactttgggaggccgaggcaggcagatcacctgaggtcaggagttcaaggccaacctgaccactatgatgaaaccccacctctactaaaaacacaaaaattagctgagcatgggggcatgcgactatagtcacagctactcgagaggcggagacaggagagtcgcttgaacccgggaggcagaggttgcagtgagccgagatcgcaccattgcactccagcctgggcaacaagagcgaaactctgtctcaaaagaaaaaaaaaaaaaaactagccgggcacagtattgcgcacctgtattcccagctacttgggaggctgagatgggagggtcatttgggcccagaaattcgaagctgcagtcaactatgattgtgccaccgcactcctgcctaagtaacagaatgagatcttgtaatttaaaaaataaaaggataggtaggatttacagactggaaaatgggaaaaagatgagagtggaaaaaggaaggaggggtagcacgaatggcgggcaggtggacagaaaagtaaaattcagccatgttcaaaagggaacaaataaaagcaccgaaaggtaagacagacctagtatatttatgacttgaatcccaagctacgaaactggaacataatttagcagagagactccaaaagttttacagcaaaaagtattagaatcatttatatactgggaaaaaatagcctcctcattttaataatccagattgggaaatcagatctaaaacagatgttcaatggacatcccatttcttttgtaaaagcaacttgagtggtcagtcatcaagttttgttctgtttttaattcacaatgaaaatctgactactcatttattcaacaaatatttgagtgccagctatgtgctaggcactgttctaaacacgccaataacatttatttagtgggattgattctgtactctagaacaatggttcttaactggggagagggagtaatttttgctccccaagggacatctggcaatgtctaaagacatttttggttgtcacgggggcagggagggggggaggggtgcgggtgtgctactatatctagcgggtggaggccaggaatgctgcttaacatcctacacacaggagatactgcccatgacaaggaattagctagtccaaaatgtcaacagtgccaaagctgaataaatctgttcaagagcaacacatttctattccctcttccatagtaattgttaataaacattagttccattttctactatttctgttctacaatagaggctttaaaatatcttaagaaatataacaccattttaataatttggcaagtagaagtaaagataccatgaatcctgagatttcactttcaaaaatgtataagctacatttattttacaatataacttttaggaacaaagttgtcttctccttctgacactgactgttatcaaaaactgtgctaaaagctttgagtgatgtttgattattccttttattttggggtccttatagcagttaattaccacattctgccagttctttccaagtgaatgcctcacatttcaacggatccttttctattaccaatgtatcatctgaaatattttactaactggtttttctgaagctcaatgtccatgtctccttccctcccaagctatccctacccattaatactgtatttttcacctgctcaaaagtccatatggttgcccgtaacataccaaataagaacctaattcctaaagcttgacattcaaatccttttttcaactagctacaatccacttttccaactcttttttccactgctctccctcaggagtagccttttttagcaaaatgacttattctgagatacataaacaacctttccagatcagagacatcaaaagccattcaggcttcattgagacaaaagatacgcattcaactcagaataacagtaagaaatcaacttatagggaaaccagatctagccatgttctataaacatgagagataaccctgttggctcatgccactgtccttatttataacggcccctatttgcctttctacttctctgaactccttatccttcaaatctaccatcttttcaaaaacccaaacacagagtcacctcagtcaccattacctgcccttcccccaccccacccaatgcctgtggctttcaggtcatttattttgcaataaacttgtcatctcaattttactggttctcttttagattcagacagctgagattatgatagattcattagtaagctgaatggggaagaaaaggatatttacattcccaggccaattttcaatgctttttggaagattctgttaaattcacaatttccagaactggcaaggaataggtaaatatatacactcatatattactggtaagagtataaattggtataattatcctaaagtgatatctgccaacattgaaagtctttaaaatctgtatactctttggcctaggaattcaacttgaaaatttatcatgagtaaattataaaatgtacaaaggtttaactataaagacactcatctctgcattgtttctaactctcaaagattgaggtggaggggaaaattccttgtccaataaaaaaagactattccatgaatcatttatttaagtaatgtaatactctgcaactactaaaatcctatagtatcatggttattgacatgtaactcttttaatggctttctttcctaagctaagaaaaatacaaacatgattccacataatgtatttcaaatatttgtatacatttttctacttttctatattttccacacatctatatataatttgtgtgtgtgtgtgtgtatgcatgcatgtaaataaaatatacctctaagtcttgtaaccttaagatggtggggcaaaatatttttattttctgttgttgattatttaaaatttagctacattaaattttttctgatttagtaaacatacataaggcctatttatagttgaatggcagtcttacaaaacctaagcaaccttagtttacattatctgtgggaaaagcatttttagtagaatgcttgcacatcttcctacattcctgtaatcaaacagtatttatcatcaactatgttggtgactctcactttgacataggctgaaccagaaatcctaggaaaaactgatgatagaaagctaaggggaaggacaggaagccgggaaaccctgggaaaggagggattatattacacatgttatgggaactagtttgtatatgcggggcacagagcatacacttagataagaagggggtcataaaaccagaaaggcaataaatagaatgttatgagcatgaactctagatgcagactgtttaggttcaatcccacctctgcttcttactacatttattaccttaagcaagtcacttaacttctccctgccgtttctgccccatctgtataatggggataacagaccctaccttagagggttgtcacactaatgaattctgagaatagtgcctggtactacagttaagtgctcattagttgtccacactcatcatcgtcattactcctattactatgacgtgaagagttgtgctgctaggacaggagcagcaacttttcaacaccaatcacttttttagatggcctcctttctagccttgttagttgcccaaattctgaaaaaaaaaacaagaactaagactctagaaggagatccgagaggcagacatgtgtgtctgtgtgtgtgtgcgtgtgtgtaggcgcgtgtgcatgtagatgaaggaggaatcaggagtaatgccaagaatgagaaatctgtataagcagttcagaaaaggggcatcatgagtcactctcctcagtgctgccccaagagttccacagtttgttccttacatcattcacttggataaaacctttcaatgtctctccatggccttcagagttaaatcaaaactattccttggaatgacttaaaacccatactacctctaaagcctcatctcttgactctctcgcaccaagctcactgagcttccagccctactgaatttcttcagtaacaaactctcacatctcagagcctttgcacatgctgctccctctgcctgaaaagtaacctctacctcctccaatagcaaactgctactcaaccttcaaaatgcagctcaaggataactccagagctctttcctgatttcaagctaaatgcctctgctatattatcccccatgtgcataacaccaccaccaccaccaccaccaccaccaccaccaccaccaccaccaccaccaccaccaccaccacgctgcactgatccaccactagccgatgactcctttagagatcttgtctttgggtatttccagatactgtcctatacagtaacagatacattaaaaataataattttaaaaatttattaatcacagctggaaaatacagtgaacctactgattacactggaaactggtaaagaaaggtaaacaagcaaacatttattctgcctttcccatatgaacagttacactgggcaaccaagtaagaggtgatggaaacttttctttttataaaacagtattccagataataaaatgaaggagtaacacaactagaacattatcattttacaactcttaatgaatcaacagatctaggcattagtcaccaacagttgctaatgtcacaaaaagagacaaccatattttgtgcctcctgatgaaagaatgcaccacaatataagaagcagtcttataaaataagactgaacctgactctgaccaagcctctggttctaactactcatttggaaatacagaaaatagagaaacatcggggataaacctggtattgaatctcaggaatcagcaaaatcctgactacaggaactctacagggcaaataacccatttctttaacaaataaattgtgagaataaaaaggaaggtggtatcctacagattaagacacttaatcgcaataagtaagccttattcaaatacttttaaaaattgagacgtgttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctccttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaattgagacgtgtttacctgaacatagaatatgatgatattatggatttaactgtcaatttttttttaagtatgatggtggtattaggtttttcttaagccttcactttttagaactacattctctaatatttataaacgatatcacattatgcctgaggccaggtgcagtggctcatgcctgtaatcccagcactttgggaggctgaggcgggtgaatcacctgaggtcaggagttcaagaccagcctggcaaacacagtgaaaccccgactctactaaaaatacaaaaattagcctggcgtggtagcactcacctataataccagctacttgggaggctgaggcaggagaagtgcttgaacctgagaggcgaggttgcagtgagctgagatcataccactgcactccagcccgagtgacagaatgagactccgtcaaaaaaaaaaaattaataaaaataaaaataaataaaagcacagaccctacagaaaagactgcctgggttcaaatcctgtgtccatgactcactctgagccttagcttcctcagctgttaaaaaagaaaaaaaaaaaaaaagggacaatagtagtctttacttcagaggacttttgtaagaattaagtgagttaagatggttataacatatagttctcccaaaacagtgcttcatagaagttttcattatcatcccccttcccactttacagaaagaaacacggacctggagaggtgaaaagtgacttgcttaatgacttgaaaaccatcttccaggaactgtgcttagcactggtggcaaaaactggctatttaccaaagcgtttccttttcctcctggcatatggctaaactacatttcccagcttccctttcacatgactggtctggacaatgaaatgtgggcaaaagtgaaagatgcctctgtactactcccaggccttgtccccaaacctcccatgcaatccctcaccgcttctcaccctcatttgccaggtggacatcaatgcctagggcaacggagaaaagattagcctgagtcccagtatgacttaactgttactgtgttactcttgaaatttcggccaccataaagtcagtaagactgtattttttatggactcatcacaacaaccattattcctattcaacagttgaggaaactgaagtataaagaaagtcatggtcaattactcaatggtagatccagaacttgaaccagcactgtcttaatacagagctcgggatcttaagtgacttccaagatcacaagaccagtaagggcaccaagatttctaacttagagtagatacattttatatagaattttgttaagtattccttaaaatatcactttaatatgccataagaataaccacagaatagtgttactttaaagtaaaaagatataaataggagcccaaaatgttaagtggggttttacaatcaagaagacacaccagaataagatattttttaaataccatgtacattaaagagatcatacttccttaccctaataaacagccatgtagtacaagttttaactttttaattaaatattaaaattattaaaaatattaaatatacaacttctatttggttttatctgagccattcctttatactgacagttacatgatgtgatttcagttatatatgtagttattggtaatttttcaaaaatagaatataatgaaaaaacttcatttcaatcattactgaactgcacctacattaatcacaatatacctatgaaaagatgtataacatatactagtatgccaaaaaaaaaagtgacaaaacagtatttatagtataattccatttttttttttttttttttgagacggagtctcgctctgtggcccaggctggagtgcagtggtgccatctcggctcgctgcaagctctgcctcccgggttcacgccattctcctgcctcagcctcccaagtagctgggactacaggcgcccaccaccatacccggctaattttttgtattttttagtagagaccgggtttcaccgtgttagccaggatggtctcgatctcctgacctcgtgatccgcccgcctcggcctcccaaagtgctgggattacaggcgtgagccaccgcgcccggcctaattccatttgttttcaaagaatatatatgcctatgtctgtatttttttctacatacatacacgtcttatctacaaaccaaaaacatctagaaaaatatacaaaaaaagcttccagtgataacctctggggagtaaaactgaacttgtgatgtataccttttcttagaatttgaatttatgaaaagcacatatacctttagaataaaaaatactttaaagctctatcatttacagtaatgcaaagtgatccaactctgaaattcccacataatcatgttatgcagtgaagctttctaggctggggggaaaaaatgtaacctcttcaaaaaaaaaaaataaataaataaaaataaaataaaaaaattgtaacctcttataatgaatatataaatatatataatttcattaatttcattcattatgggtatacatttatacatctatttacaagtaagtctgtttaaatacacatatccacacctgctaaataaataagtatgctctggccaggcgtggtggatcacgcctgtaatcccaacactttggaatgccgaggtgggtggacctcctgaggtcaggagttcaagaccagacttgtcgacatggtgaaaccccgtctctactaaaaatacaaaaattagccgggcatggtggtgtgtgccagtagtcccagctactcgggaggctgaggcagaagaatcgcttgaacccgggaggcggaggttgcgtaagccgagattgtggcaccgcactccagcctgggcgacagagcgagactgtctcaaaaaaacagaaacaaacgaaaaaagtatctaatcaggagattttggtaagcttttcaagcacacccttttttgtgaaactgagttctaacctgaagaatacctgggattgtatggcgaaaaaacacaatatattaaaattttaaaacagttcttattttaggctcaaattttatgttttggggactacttagacttttttttttttcctgggatggagttttgctcctgttgctcaggctggagtgcaatggcgtgatcttgggttactgcaatctctgcctcccgggttcaagcgattctcctgcctcagcctcccaagtagctgggattacaggcatgcaccaccatgcacagctaattttgtatttttagtagagacagggtttctccgtgttggtcatactggtctcaaactcccaacctcaggttatccgcctacctcggactcccaaagtgctgggattataggcatgagccaccgcgcccgaccaactttttgtatttttagtagagatggggtttcaccgtgttagcaaggatagtctcgacctcctggcctcgtgatctgcccgcctcagcctcccaaagtgctgggattacaggcatgagccactgcgcccagccaactgtcactcttaatttttttaaattaaaagaaattaaatttctcaattctggagactggaagtcccagctactcgggaggctgaggtaggagaatcacttgaacctgggaggccgagactgcagtgagcagagatcgtgcagcctggtgacagagtgagactccgtctcaaaaaaaaaaaaaaaaaaaatactgtcacttacgtcactcagtttgtggtattttgttatggtagctctagcaaactgataggagaggcctctagtttacactatttaaattttctaattatttactttttttttttttaaatacctggtggagtgcagtggcacaatcacagcttactgcagcctcgaactcttggcctcaagcaatcctcccaagtagctgggactacaggcatgcaccaccatacctggctaagttttatttttttgtagacatgaggtttcactatgttactcaggctggtcttaaactcttaagctcaagtgatcctccagccttggactcccaaagtgctgggattacaggtgtgagccaccatgctcggcctacacgaactttttttaaactagcaggggttatgtgaatagtgggattacagacattttcttcattatgctggtccatatttaaatcctctccccctcgcaaaaaaaggtaaaaatatacagccataaaaaagaatggaatcatgtccttcgcagcaacatggatggagctggaggctacactctttttcatcctctatcctaaaagaagtaactcagaaccagaaaatcaaataccacatggtctcatttgtaagtgggagctaaacaatgagtacatgtgaacataaagatggaagtaatagactagagattccaaaagagaaggtagaagaggaggcacacaggttgaaaactacctattgggtactagggtcactttggatgatggctgcgctagcaggccaaacctcggcattacataatctagccatgtaacaaacctgcacgtgtaccccctgaatctaaaataaaataaatttttttttaaattgtaaagaaaaaaagtattaaatgacataactaaatattctagacatcattctaccataagttgtccaagaaaaaccacattttaccttactgtttatcatttgaaataaaatattatgttaagatattttaaatttttaccagttccacaaaggaactaggaagtagaaactgaagaacactttgttaaacaagtccttggggattaaagaagtaatagctacgaagtatacaacagtgtgatgagtgaatccttctcatattggggttaaaatggtcattatagctactgagtaccacaaatccaatcaagttaggtattttgtatacattatcatttaattctcattacaacccatcacaatagatgttaattagtatgtcccctatttttcggataaggacattcaagatcaaacagattaaatggtcaaggtcatacaactaagaaatgaaagtgctgagactcaaacccaagttcatgtcttaaatcccatgccgtttgatattaaggaccatgtgtgtttaacaaatattagacacctgctacacacacacacactgtgccagatgtataagatagagccatgacccaagaaatacagtcactattctcaaaaaacttagaatctctgccaggagcaacggctcacgcctgtaatcccagcactttgggaggccgaggcagatggatcacgaggtcaggagttcaagaccagcctggctaagatggtgaaaccccgtctctactaaaactacaaaaattagccagtcatggtggcaggcgcctgtaatcccagctacttgggaggctgaggcagagaactgcttgaaccagggaggcggaggctgcagtgagccgagattgcaccactgcactccagcctgggcgacagagtgagactgtctccaaaaaaaaaaaaaaaaaaaaaaaaagccttaaaatctcctctttaacattctgttgcatgtatgtttttcctaggttttttgtcgttgtttgttttttgtttgtttttttgtttttgagacagtcttgctctgccacccaggctgaagtgcactgactggttccatctcagctcactgcaacctccgcctcccgggtgcaagccattctcccgcctcagcctcccgagtagctgagattatggtgcctgccaccacgcctagctagtttttgtatttttagtagagacagggttttgccatgttgaacaggctggtcttgaactcctgaccttaggtaatctgcctgccttggcctcccaaagcaatgggattacagacatgagccactgcatgcccggcctttttttttttttttttttttgacacagagtctctggcacacaggctggagtgcagtggcacagctcactgcaacctctgcctcccaggttcaagcaattctcctacctcagcctcctgagtagctgggattacaggcacacaccaccacaccgggctaatttttgtatttttagtagatacggggtttcactatattcaccaggctggtctcggcctcagcctcccaaagtgctgggattacaggcgtgagccactgtggccgttcttgtttttcctgtctttgtaactagactttaaagctcctcaaaagagctggagtataaacgaaaacacaaagagctttgagtctcagatctggaaaaattctagctttatcatatacatacataaatttaaatgctggattcctcaccagtaaaagggtcttggattaagtgatataaagtagtcctgtgcttatccataggaaatacatttcaaccccataccctacccctgcctggctcccataaatgcctgaaaccacggatgctacaaagccctatatacactatgttttatatttttctttgcctgcagtgaattccctctcttggcaatgccttataagttaccatgcaaaaaaatataaatgtatctcatttatctgttctcccctaccccccacaaccctacctacctctcacaggaccaagaattggaaaggccttagtgtagccaccacctaaccacagaaatgatccaaactcacatactactacttctttatttttcagtaaagttctccaaactaaaatgaaatatgcagtttgaaaataggtagtaaaaatacagcttttaaaatatatcctctatgctgtttcatagccacttcacaatgaccctacttccccatttataactcacctagttagttattagtaaacaactcttaatcaaaagtaaaaatgaagggctatggaactgttctcatatccccttcagtgtcttaaaggcactgtgctcagcattccacatgcattatcttattgaaagcgcagtgtttaatgaacttgcctaaagtcacatcagaaccaccaggaagcacaatttcattgtattttgtgtgaatgccctccccagcacaacaagaacggagctgtacaatgaagtggtctgggtcacacagctaattaagtaatggagttaaggctcaaaaactcttcagtatctgatgagaaagctcacactcaaaacctccaaaaaacactgcttcacatcactgaaattaaagaacaataatacaatataagtaaaataaaatgagaattccttgttatataataagccagtttatcagctttttttgaaggaagaaagggcaacatagtgatatcttgtctctactaaaaatttaaacattagccgggtgtggtggtatgcacctgtagtcccagctactctggaggctgagtagagggaggattacttgagccagggaggttgaggctgcaaggagccatgactgcatcactgcactccagcctgggtgacagagtgagatcctacctcaaaagtggtgttttgtttttttccaccaccccaatgctacctctataactcacacatgatagttttataaagataactacctggcattcaggttaaaatgacaactgcacccagaataggaaaaactataaattatgcattggactctgcgatcaccagcccctacttgtaaatttcaatggagattcactttatttcaaaattagaaaactgatctcagagtttaaaacctcatttacagctccaaaatatttagaatctagaattatataacaaatacttactttcttagcatgcaaaaattatttacaaatcatttaaaaaggatgatcgacttaacagaaaaatgggcaatgacaaacagactattagttacctaaccaatagccactccccactcacaacctgttccttacagagtccacttcccattatcatggctgcaaggaacatccttgctctctcaccctcacttgtatctaggacatggatggataccaatcacggctgatgggatttaagaaaaaaatctgttggccgagcgcggtggctcatgcctgtaatcccaacactttgggaggctgaagcaggcagatcacctgcctgaccaatagagagaaaccctgtctctactaaaaacacaaaattagccgggcatggtggtgcatgcctgtaatcccagctactggggaggttgaggcaggagaatcgcttgaacccaggaggcagaggatgcagtgcagtgagccgagatcgtgccattgcactccagcctgggcaacaagaagcaaaactccatctcaaaaaaaaaaaaaaaaaaaaaatctgctaagggcttccaggaaaggtttttaattccaaataaaatagatgtgcatgaacaaatatacttcatctttactggtcattgaacctggtgtgaactacgaatcctctttttctcacatgccacatccctcaacaaatcttttcggctctgcctcaacatatgcagaattacttcaacatttctctgatgcctatcatgcttcaaatcatctgttaccctgctaatattatctaacatgcctgcttcttccttgatctccttcattctagtctcaacacagcagccagcatgagagttttagagtcttggtcagataaagccagtcctccacttaaaagcccccaaaggactctcatctaatccagagtaaaagtcaaaagatctcacaatggtctacaaggccctgcacaatctgactccccacgctacttctcttatgatgttttctccataactcagctcctgccacactggccctttcagttctatgaacatgctaagcacattcctgcctctggggcttttgcactcactgttccccgcatcagcaatgctctttccccaaatatctgcctttgcattcttatttcttttaagattctattcaaacatcagctcactgaggccttctctgatggccccacttaaaacaatccaacccagcccttcccgtcccttccatggctttatttttttccataaaacttaacatcttctgacaatctataaattctacctatttgtttgactgtcttctcccttatccccactaaaatataagcccgtgaaggaaggcaatgaactttgttttgctcactgctgtatttcccgtgcttatggactactgcctaatacattttaggtggtaaatgattatttaagtgaattaatttagcaactatcgacaacaagctgagtataaaacagcaggaaaatgaaaaccatctaggtccgtgataatttaattgagccactgaattacacctggacttccagtcatgtgaggtaaattttatttatggtttaatgcatttttaattaaaatttttcttatttgaagctgcaaagtacccgaaatagggtactggtaggcagtttgcaaaaaaaagtgacaaatataatcaatttaactcaatcgtaaggcatgccaattaaaataaccatgaaataatctcactcaagaaaaaataaaagtttggtacatgtataatcccacttaatatgactcattacaacaatagtagcattaaaaaaattttaagggttttttgtttgttgagacagggtcttgctctgttgcaccggctggagtgcagtggcgcaaccatgactcactgcattctcgaccttttgggctcaagtaatcctcccatctcgactcctgagtagctgggactacaggcacgtggccgcacacctggcttttctttcccccccccagttagagacagtgtctcactatgttgcccagcagactggtctcgaactcctgtgcttaagtgatcctcctgtcttagcctcccaaagtactagaattataggcatgagccacagtgcctaaccatttttaagttttgttttgttttgttttgttttgtttttgagacagtctccctctgtcactcaggctggagtgcagtggcgccatcttggctcactgcaacctccgcctcctgggttcaagtgattctcctgcttcagcctcctgagtagctgggattacaggtgcctaccaccatgccaggctaatttttgtatttttagtagagacagggtttcaccatgttggccaggctggtctcaaactcctgacctcaagtgatctgcctgcctcagcctcaggcgtgaaccaccccactttctaagttttatacctaaatattaatatatataactcagtaagagtgtgatatcctatcaccagtattttccccacactttgagtgctagataggactgcccactcttagccaattatataaaaatattagttgatgctgataaagtgcttcctcttgtgctggccacttttacatgtgtaacttactgcccgcaacaatcctacaacctacaaaaccttgttttcccattttaaagctcagaagactgagctacaaaaatagatcaatgatcagccccaaatcaaacagctactaagtgtgaggctgggatttgaacataggcagttctgaaaaccaaaacccaaagcattacaaacactatcacccataagcagagcattctcctaaactgaatgtgccttttcctgccatttattctgtgtttggattctgacccacaactactgacaaaaggtattcaagtaacagcgccaaacttcccaaaagatattttgacagaaaaaaattaattaaaaaatacataaatgaaaagacaaagattggtggacatcctctgtctcacttcaagaaatcgagataataacagtaattactttttaggttgttgtgaggattaaataaattaatatagtacgtgtaaagcacttaggatagtgcttggcatacattaaaccaattaatagttttcattttcattgtaattctcataattattatgaaaggctccataaataccactaagcctagaaggactgaccaacagctatatgattagtaactggaaaaaactatggccagagacatgttatgactttagggataccaaaaagaaaacgacaattgctgattttcattctaggaacaaagtgccaaagtgatttagtaaagaaaaaatgctattagaactcccactcccattttcagaaatgtaggccctgcctactttctctcccaccaggtatgttgttagtgaggatgccaggaaaaaggcatactctgttgggggaatccaagccaacacctcacttttggagggcaactaatgaatatccatcaaaacttgaaacatatgtactgtcctcttcgatgagagaactttacatctaggaatttatcttccagaatatgtccacacgtacaaatacacaagtacaaggatattccttacaaagataataaaactggaaatcaactaaatgaccatcagtaggggaatggtttaactaatcagagggccttcaatctagtttaaaacctgtttctccactaagatcaatctctaatctaagtaaatgacatttctgtccactcaactactgaagccacaaatctagaagacaattttaattcttctttatctcatatccatctcatcaaatcctttagcagatcttaccgctgtaactttccaagctttttttttttttagatggagtctcactctgttgcccaggttggagtgcaggggcttgatgtcagctcactgcaacctccacctcccaggtacaagcaattctctcctgcctcagcctcctgagctttccaaacacttctgattgcctttctcctctgccatcactctactctaagccatatctgtcaaggttactttcacagccttatgggtgccctggtttataaccttctaagggcttttgctgcactaaggataaaatcccagcttcttaccacggtgtgaagggcactgcttgggctcctgcttgcctctcaaatatggtctcctaagttcccctcattgcacagtaacaccaatcgtttattttgggagatgggaggatcccttgagtataacacacttgatatggtttggcagtgtccccacccaaatctcatcttgaattaaagctcccataattcccacgtgttgtggaatggacacagtgggaaagaattgaatcataggggtggtttccccatactgttctcctggtagtgaataaatctcacgagatatgatagttttgtaagaggaaacacctttcacttggtactcactctctcttgcctgccaccacgtaagacatgccttctgctgtgagtgtgaggcctccccaaacacatggaactatgagtctattaaacttctttttctttaaaaattacccagccttgggtatgtctttatcagcagtaaacgcactaatacaacactcattcttgttttgagtcttcacaataaatcctgctcttcctaaaatgcctccacatcattcacgtgtgtttcaatgccatcacttcatacagaccttcctgaccaccttagccacatgcgttctctctcataccattaacagacacactcagtacagtaccacattttattttcttcatagcacttctcagtatttgagactaattacgagaaatgcatttattttgtgtttctcaccgttgaaatattgttccataagggcaggagcttggtctctctggttcaccactgaatccttacacctaaaacactccttggcaaattaagcacgtgattcatatctttggataaattttgaaaagaatgagatagatgtgtataagctaaaatggaaagatgcctaagatcaaccacaaagtgacaaaatcaaatcacgatataaattaaatgatcccattatcataaaaatggatataagtacatacacatacatagaaatagcaaaggtatacccataacaaaagtcaaggatacagtaattgtctctgaaatgtggggcaaaacagggaaaagagggtctttcacattttttgttttttattttagataagaggctcactctgtcacccagtgaaacacatgttgcccaggctggcctcaaactcctggcctcaagtgatcctcctacctcggccttcccaagtattgagattataagcgtgagccccctgcacccagccccttttactttttaagttatgccctcctgtgctctttatttttaccagaatgtattacattcataactttttatgtgacatcttctaatcttccacatactgtaaaaggcttaacacacataatgagtactcagttttgttttggagacagggtttcagctctgtcacccaggctggagtgcaacagcacaatcttgactcaatgcaacctccacctcctgggctcaagggatcctcccacctcagcctctgagtaggtaggactacaggttcgcaccaccaagcccagctaatttttgtgggatttttttaggggtagggtttcaccatgttgcccaggctggtctccaactcctgagctcaagcgatccacccaccttggcttctcaaagtgctgggatttcaggcgctcaccaccgcacccagccagtactcgcttttataaacacgcaaaacacctcctacaccacttaaagctgctattatatttctacaacctaacacattctgaaacactggataaataaatatctaaataattattagtttttggtctagtccagtttgagaactgaaagagattctctggctcaaatagcagatcaaacatatacatttatctctcttcagcaaaagaccattttaaacagtagtttaaaaaaatttaaagccaaattattattaaaaaacaaagtaaaattaatggaaagagatctcttctaaagtaaagaaactggagtctgggagagaggaaactagtgaacctagcatgggagttggcactttggggtaaaacaatggactcttgaatgtcagaatacaaaagactaattaacagcttaaccctaaagtaaagcctgcctgccaaccattaattcccaccaagagctcattgtgaacccttctactaaatcttaaagctgagtgatatccaaggtcagcagatatttggttaaaagcctacaatataaatgagactaagataacaacaaaaattacaatagagttgacaggtaagagggagggcaacaaaatttaaaaaaaaaataaaccttattaacattttcagagactcaagaagattattaatccataaaatgagaaaagatattggcgggggaggaaatgaaggagaaatctcaaacatttaaaatataacttccaatataaaattaaaaggtccaagaataaataaagtagaagagatggccagaccaaaaaaaaacaaacaaacaaacagacaaaaatattggggaggattaattcagtaagtctaataatccaactaaaagcagctatagagaaaacaaagaaaagatcactagaggccgggcgtgggggttcacgcctgtaatcccagcactttgggaggccgagatgggcggatcacgaggtcaggagatcaaaaccatcctggctaacaaacacggtgaaaccccctctctactaaaaatacaaaaacttagccaggtgtggtagcaggtgcctgtagtcccagttacctgggaggctgaagaagaatagcttgaacccaggaggcagaggttgcaatgtgccaagatggtaccactgcactccagcctgggcaacagagcaagactccgtctcaaaaaaataaaaaaaagaaagatcactaaagccgtaacatgaaaactttcaagaagtgaagcacataaagtattttgcttattgtaatggagaagaaaacacatctggacatctttgagaaatttcagtttaatgaggataaaagaaggctctaaagggatggatgaaaatatgaaacacatcacccacaaaggaagaagaatcacacagtatccgacttttcctcaccaacaacaatggacatagaagacactggagcaatcccttcaaaactctgagggaaaacaattttcagcttaattgcacttgaataaaataataccagtcaactgtaagggctaatgaggacttttacagataagcaaggattcaaaactttatttctcacatattctttcttagctatttatgtgggtgtactgcattaaaacaagttagtaactcaagaaatgataaagctctaataacagtagtagcactgtgcaaaaagagtaaggaaaagttcagcacaaaaacaaggcaacaggtctaaatacttctagcccaaactgaaggaaataggactaagggaaagcaggggagggtgggagggacttgatatgcataaaataagtaataatgacaaaccacagaaaaagattgataaaatgaatcgtgaaaatatgacaagaaaaatgcagttacagattcaaaaaccaagaaacaatacaaagaaatgtaattacatactacttgcctctgctgtgaaaaatattacatgatcataataatgtagaaactattcattaactttttttttttttttttcactctgtcacccaggctggagtgcaatggcaccatctcggctcactgcaacctccgcctccggggttcaagcaattctccctgcctcagcctcccaagtagccgggataacaggcatacgccaccacgaatttttgtatttttagtagagacggggtttcaccatgttggccagactggtctcggcctcccgccctcaggtgatcagcccgcctcagcctcccgaagtgctgggattacaggtgtgagccaccacgtccagcccattaactttcaagtattaaagtcataccggccaggtgcagtggctcacacctgtaatcccagcactttgagaggccgaggcaagtggatcagttgaggtcaggagttaaagaccagcctggccaacatggagaagccccgtctctactaaaaatacaaaaatttgccaagcacggtggtacgcacctgtagtcccagctacttggaaggctgaggtaggagaatagcttgaacctaggaagcggaggttgcagtgaaccaagatcgcaccactgcactcaagcctgggcaacagagcaagactgtctcaaaaaaataaataaataaacaaacaaagtagtaaggagtacaatacagcgcataactgttctcaaccttgacaatgtcaatgtcagaaatgacagatgtaagcacataaagggaaaaggaaaggtaaaaagaagagttgcagccgggcgtggtggctcacacctataatcccagcactctgggaggctgaggcaggtggatcacctgaggttgggagttcaagaccagcctgaccaacacggtgaaacctcatctctactaaaaatacaaaattagccaggcatggtggcgcctgcctgtaatcctagctactcgggaggctgagacaggagaatcgcttgaacccgggcggcagaggttgcagcaagccgagatcgcgccattgcactccagcctgggcaacaagagtgaaactccgtctcaaaaaaacaaacaaacaaacaaaagttactgcttggtacatcaagatcaacagtctatataacatgaaggaaagttctgatataaactgcagagataactagcagagaaattaaaagtgatttttaaaaaatctattggggaagcagatgtaaagaagccaaatcctcctttatcagagcagaaatcaatcataaatcataacatatgtatattatatagtcacgacaataccacaggaagaaataatttgaaagtttcctttggaaattggacccctatctttcaccatatacaaaaatcaactcaagaaggattaaagacttcatccaaagacctgaaactataaaaaccattagaagaaaacctaggaaaaactctcctggacactgatctatacaattcatgactaagaattcatgaatttaaagaattcatgactaagacctcaaaagcacaagcaaaaaaaaaaaaaacaaaaatagacaaatgagacttaagctaaaaagcttctgcatagcaaaagaatcagcagactgaacaaatggcctacagaataggagaaaaaagtttcaaactatgtatctcacagggtactaacatccagaatttacaaggaacacaaataatcccatcaaaaagtaagcaaagggctgttctgaatacctcactactgataactggtagtgagttatcccaattgatggttcactgtcagttaccgatcaaattccttgttctatactctttactcccctttcactactgcacttaactggtcttaagaaaaaattttaataaaaaatttttaagaattttaaagttagcaaaggacattaatagacatttctcaaaagaagacatacaaacagtcaacaggtatgtgaaaaaaatgctcatcactaatcatcgaggaaatgcaaataaaaaccacaatgacatatcatcttacaccaatcagaatggccactattaaagaaacaataataataacagatgttggggaagatgcagacaatggggaacacttaacacactgtgggcgggaatgtaaattagtaccacctgtatggaaaaccatataaagagttctcaaatgactaaaaaataaaactgctggccaggcacggtggctcacgcctgtaagcccagcactttgggaggccaaggcaggtgcatcacctgaggtcaggagttcaagaccagcctggccaacatggtaaaaccctgtctctactaaaaatacaaaaatttgctgggcgtggtggtgtgcacctgtaatcccagctactcgggaggctgaggcaggagaatcacttgaacctggtgggcagaggttgcactgagccgatatcatgtcattgcactccaacctgggcaacaagagcgaaactccatctcaaaaaagtaaaaatgataaaaaataaaactgctattcaatccagcaatcccactattgggtatccacccaaaggaaaataaatcattatatcaaaaagataactgcactcgtacctttatcacagcaacactcacaatagcaaagatagggaatcaatctccatatccatcaacagacgactggataaagaaaaactgggacacatacacacacacacacacacacacacacacacacacacacacacacgaatactattcagccataaaggaagaatgaaatcatgtcttttgtagcaacgtggaaggatggaaggacctggaggccatgttctcacttataagttgaagcaaaataatgtgtacatgtgggcacagtgtggaataacgacactggagactcagaaggttgggaggctgggaggagggtgagtaacaagaaattactgaatgggtacacgtacattatttggatgatggatgcactaaaagcccaaactgcagcactatgcaatgtattcatgtaacaaaactgcacctgtaacccttaaattgatacaaaaaagttgtttggagagtggcaataaggagtgaaacagaattcttgatccttattataagcattctgggctattagacttttttcaaccatgtacatatattactatgcaaagtttttaaatggacttaaaatctgaaagaacattgatcttttaatgaaaaacaaaaccataagatactctgcctaaactttccctcataatgcaatgaataaaactttaatctttctcttcaggataaataatttctgaggctttagaaccaccttaaaaggtatctctaggccgggcgcggtggctgacgcctgtaatcacagcactttgggaggccgaggtgggcagatcttctgaggtcaagagttcaagaccagcctggtcaacatgctgaaaccctgtctctactaaaaatacaaaaattagccaggcgtggtggtgcacatctgtaatccagctactcagaaggcggaggcaggaaaatctgaatccgggaggcagaggttgcagtgagccaggatcgcagcactgcactccagcctgggcaacagagcaagactcaggtctcaaaaaaaaaagatatttgttgacaactaaataagtcaagttacatgatgtatagactatcatcaaaattactgaaccgtcactgcttatcaaagtaaaatgtaaccaaaaatttaatgcacagtacttcgaccagaccaaaacattcaattcatccatagtttcctaattttaatacttattttaccagagcatgaaaatcttttttgtttttttgttttgttttgttttgttttttgagatagggtctccctctgttgcccagtttggagtacagtggcacaatctcagctcactgcaacctctgcctcccacgctcaagcaatcctcccacctcagccttctgaggagctgggaccacaagcgtgtagcactgtgcctggctaatttttgtattttctgtagagatggggtttcttcatattgcccagctggtctcaaactcctgagctcaagcaagccacccgccttggcctcccaaaatggcaggattacaggcatgaggcaccacaccccaccaaaaatgtatctttaacacctgttctctagattgatttaggttttactgatcttagaggtatatacaaccatcatttcaaactcaacagatctaaatttagtttaacttcacttttttttttttttttttttttctgcccaggctggagtagtggctcgatctctgctcactgcaacctccaccttctagggtcaagtgattctcatgcctcagcctcccaagtagctgggattatagacatgcaccaccacacttggctaatttttgtatttttagtagagatggggtttcgccatgttagccagactggtctcaaactcctggtctcatgtgatctgcccaccttggcctcccaaagtgctgggattacaggcaggagccactacacgctgcctagttcactttgcattctattttttcctttgtaccttttagaagaagcttttaaataatataaagattattatttttcaatctgtcagaaattgacagggaaaagaacttaaaagtttaaatacacgatacaaaaagattaaaaagttatcgcaaattggcagggtgcggtggctcacgcctgtaatcccagcactttgggaggccgaagtgggcagatcacccaaggttgggagtttgagaccagcctgaccaacttggaaaaacccagtctctactaaaaataaaaaattagctaggcatggtggtgcatggctgtaattccagctactcgggaggccgagggaggagaatcgcttgaacctgggaggcagaggttgcagtgagtcaagatcatgtgcgccattgcactccaacctgggcaacaaaagcaaaactctgtctcagaaaaaaaaaaaagttatcacaaattattgctcataacagtttagttaaaataaagaatgtatgtaaaactacagagtaatagcttgatagcaagacaaaatagtttttaaaaaaattctaggaaaaatatggctgactaaactatgatgaaagatttgagatatcaaaaatgggctgggtgcagctggcgtatgcctataatcccagcactctggcaggccaaggtgggtggatcacttgagcccaggagttcaagaccactctgggcaacatggcaaaacccagtctctacaaaaaatacaaaaattagctggacatggtggtgtgtgcctgtagtcccagctacttgggaggctgaggtaggagaatcatctgattctgggaagtccagggtgcaatgagccatgatcacaccactgtactcccgcctgagagacagagtgagaacctgtctcaaaaaaaaaaaaggcatcaaaaatggctaaaagaaaatcttaaacaaaccatgagttaacagattaaaaaggtgttcttgtttgttttttgagacacagtcttcctgggctgcccaagctggagtgcagtagtacaatcatggctcactgcagccttgaactcctaggctcaagtgatcctcctgcctcagcctcccaaataactgggactataggtgtatcacgacacacagccatttttttttcttagtagagatgaggtctcctgatgttgcccaggctgggctcgaactcctggtctcaagaggatcccgccttggccttccaaagtgctgggattacaggtgtgagccaaaaaaggtgtggggccaaaaaagggtttttttattttttggttttttttttctgttgttagaggtggaggtggtaatggtttctgttttggagggagaagaggtagtggtggtaatggtttcttcttgggaaggagtattaaggtttacagtgtttaccattttatttaacaatattctactacagaaactgaaacattttagatgttaataaaacatctaaaatcatactatgatttacttctccaaagtacaaattacatcacaagtaagcctccatgcaatgacatttttatctttatggagcatcatcaatatcagttaaataaattagtgcaaattgttcctaaggagaagtttagtttccactttaccattaaaagccaagtgcctatgatgcagatgaatgcattgtacaatatatttcaatcaagtcacagactcacttccccactatccatgaaatataacaaaggactaagaaacattaaaaaataacgtatcaaacttcccacaaaccaaaagacaggaagctactgaataatctgacacttggattacattttcattatcattaaaatgtagcaaaggggccgggcacggaggctcacgcctgtaatcctatcactttgggaggccaagacaggcagatcacttgaggtcaggagttcgaaaccagcctggccaacatgataaaaccggtctctactaaaaatacaaaaacttaaccaggcatggtggcacacgcctgtaatcccagctacttgggaggctgaggccggagactcacttgaacccgaggggcgaaggctgcagtaagccaacatcgcaccactgcactctagcctgggcgacacagcgagactctgtctcaaaaaaaaaaaaaaggtagcaaaggaaaaaaaaaaaataggtcagtgtttagaaaggatacaactatatcacgtcttttacttattttacattttgtattggtctagaagttgaaaatacgtgcccaaaacaactatacaacttgagcaatgattttaaaacaaatatgacactttatattagaagcagcaactatttattcagaaacatatactattagttacatttaaaatttatcttgttagaatacactgtttccaaatcaacagtccttacaaaatatggaacatatacttcagtattatttagctttacttttgtaatagtggccaaggtggccgggtggggtggctcacgcctgtaatcccagcactctgggaggccgaggtgggcagatcacaaggtcaggagttcgagaccagcctggccaatatggcgaaaccccgtttctactaaaaatacaaaaattaggtgggtgtggtgacgtgtgcctgtaatcccagccacctgggaggctgaggcatgagaatcgctgaatccagggaggtagaggttgcagtgagccaaaatcgtgccactgcactccagcctgggtgacagagtgagactccatctcaaaaaaagaaaaaaaaaaatagtggccaaggtggattttgtactctgaatataaactatatagtttatactatacatatgtctacttataaactaggcactactgcttcaatatattaaaaaaattattctagaagatagtttatcgtactcagggttccccccacctatagctgcagaccaataccactcggtagcctgttgggaaccaggccacacagcaggtgagcggcaggcaagccagcattaacctgagctcggcctcctctagatcagcagcggcattagattctcatagaagcacaaaccctattgtgaactgcacaagcaagggacctaggctgcatgcttcttatgagaatctaactaacctaactaatgcctgatgatctaaggtggaagagtttcacccgaaaaccatccactccgtgctccccctggggtctgtggaaaaaactctcttccacaaaactagtccctggtgccaaaaagtttggagaccactaacataaactacaaggttttgttaaaaaaaaaaaaaaaaaaaatgtagccaatgtcccttgagggttaatatcaaatatcttagaataggtaacagtctaatatgaatttaactgtgaacataatgaagttaattctacactatctaaaaaactgtttcacttaacatgcatctaattcatcaaactgggtgggtttctctctcttttttttttgagacagagtttccctctgttacccaggcttagtgttacccaggcttaagtgcagtggcgccatctcaactcactgcagtcttgacctccggagctcaacctgatccttccacctcagcctcccgattagctgggatcacacaagaatgtgccatcacacctggctaatttttgtattttttttagggtcagggtctcactatgttgtccaggctggtcttgaacgccttacctcgagtgatccacctgcctcagcctcccaaagtgctgggattagaggtgtgagccaccaagacccaccttaaaacaagttctttgaaaacatatttgctacgtaatagttatgagctttttaaaaaatttcttctaatgtaattaaattctggtaatcagattttcagaagaaatatgttaaaatgctggttaagtgggccaggtgcagtggctcacgcctgtaatcccagcattttgggaggccgaggcaggtgcatcaggaggtcaggagatcgagaccatcctggctaccacacagtgaaaccccatgtctgctaaaaatacaaaaaaaaaaaaaaaaaattagccaggtgtggtggcgggcgcctgtagtcccagcttcttgggaggctgaggcaggagaatcgcttgaacccaggaggcggagcttgcagtgagctgagatcacgccactgcactccagcctgggtgacagagcaagactccgtctcaaaaaaaataaaataaaataaaaataaataaaataaaatgctggttaagtgaccagaggttttatttcttgggtttttttttaaatcatcatggaattaaacacacatgaagaaatctgttgaaacccctcaaacttgcaatgctatacccgaatcacagtgttctttcagagacttttcaaattatacaaatatttcaaaatgctgagttactctactatagctaataaaactacttaaactaagtggaaaaccttgagaactaaagggggaggggatattatttattctcattactcttaaatcaaccaacttccaaatccagaatataaaacttttatgattatttgttctttccctgtttacaaacctagttctgatttcattattaaaaatataggccgggcacggtggctcatgccggtaatcctagcactttgggaggccaaggtagacagatcacgaggtcagcaattcaagaccagcctgaccaacatggtgaaaccccgtctctactaaaaacacaaaaaaattagctgggcatagtggctggcacctgtaatcccagctactcgggaggctgaggcagaagaatggcgtgaacccaggaggcggagcttgcactgagtcaagatcgcgccctcgcactccagcttgggcgacggaggaagaccctgtctcaaaaaaaaaaaaaaaaattagccaggtgtggaagcacacccctgtaatcccagctactcaggaggctgaggcagcagaatcgcttgaacctgggaggtggaggctgcagtgagccgagacagcgccactgcactccagcctgggcgacagagcaagactccatctcaaataaaataaaattttttttaagttttaatttatatatattatattataaatattatatataatgtataatttttatatatgagattatgtatatatgtatatgtatatgagatgtatatataatatatacatctcagccgggcccagtgactcacgcctataatcccagcattttgggaggttgaggtaggtggatcacttgaacccaggagctcgaggtcagcctgggcaacatcgagagacgccgtctctacaaaaaataaaagataaaaaaattagctggtggtgatggcacatccccacggccccagctacttgggaggctgaggtggaaggatcactggggttggaaggtcgaggctgcagtgagccaagatctcactcctgcacttcagcctggatgacagagcgagaccaagtctcaaaaaaaatatatatatggtgtgtgtatatatgtatatgtgtgtatatgtgtgcatacacacacaattctctataactagtgctgtcatacttaatgctttaataaggttaaatacataataaatacaatagttcattttgtctttaacagtacaatccaagtcaagtcatccttccaaaccagatacaaaaatatcctatgaaaagaaacaaaaactttttatccttaggatattttggggttctggccttttgttgtgccagatataataccacttgataagactttcagcttcatcccatcccatcctgcaacaatgttttcagtagggcgggatccgtggctcccaatcaagtccgacaacctgatctcatggcagggcccacacaagaaaaaaaagagcattttatttcgtgcaacttttatggcccagagaatctctgaccccccaccccctcaacacacaataatcagttgatctccctctccctccctctctcccacctccacaccatctatgagaaagaggagggggaagaaggtggaagaaaaggcacgagtagagaaagtagatccgacgtaaagcaggcacctaaaaaaaggtgggatggatttctccaaagcccagatcagggactctgctacagccagccagtggagaatgcctctaatgttaacgctttagtaaccacttacaagaacttcccctgtctactgcttaatttcaaataacccaacaggtccatttaattactttgtattatttaaagaaatctaggatttctttaaataataaaagggaaacgaacgcgttttaacatcattttgcatcacaatgttaaaatcttgggttaactccctcagtaaatctctaaatcctttccaatctactatctctggccaggaagtcaaaactgaaatattaaccaactaaaatgatcttcattctttggtcaattttgcagagcaaaaaatttaaataaataaataaatagatcttcaatgtgtatcaaggatgtcctacttgggcctcactctcccaaacagagcctattttcttccatttaacaaaggaaaattctcatttaaacaagtctaatgaagatgttgcaacctggccaagagcggtggctcatgcctgtaatcccagcagtttaggaggccaaggcaggctgatcacttgaggcaagagtttgagaccagtctggccaacatggtgaaacccgatctctactaaaaatccaaaaattagccgggcatcgtggcaggaacctgtaatcccagctactcaggaggctgaggcaggagaatggcttgaacccgggaggcggaggttgcagtgagctgagatcctgccactgcactccagcctgggcgacagagcaagactccctctcaaaaaaaaatttttttaatgttgcaaccaatttttcttcctcatatttatagatgtttatcatgttttttcttaaaagttttttaaaccaccttttccaaacctcaaaacaagcatctataattatagacaattattctcctggctccgtaaacaattctatttttccttctccaactttctaatcctctcatgaagctggccaaatgtattctactcctgacaccaaacaacagaaaaagaaacaacgtaactgcagtctacttcttttgttttaataaacaaataaactagcttaaatgcacagtggtcttggatcacataagaatttcaaaataaatgatttaaacactttaaatattgtggtgggggggatggtgctggtaaataagggtcaagttctgactttcttattgaggccaaggtcaagaaattacttttttcagatctataaaatcttaccaactcagaatcctgattatagattatcatctcctactcaatactttccaaatctacaatgatataggaatcccactaaaattcagaataattaaaaggagttaagatttaagacataaccaaaaaccagcccctctacaaggcagttgactgtacagttcatgcttgtatacagatggacagactaagaacaaactctacacttctgagaaaaaaaacaaaactaaactaacaatgtaaatctattcattcattataacaatttcttttttcggagacagggtctcactttgtccaggctggagtgcagtggtgcgattttacctcactgcagcctcgacctcctgggttcacgtcatcttcccacctcagcctcccgagtagctgggactactaacgcgggccaccatagctggataatttacgtattttttgtagagacagggttttgttatgctgcccagactagttgagctcctgagctgaagcaatccgcctgcctcagcctcctaaagtgctaagattacaggtgtaagccactgcgcccagccacaaaatttttaaatatcattccaaagaaccatctataatgaaatgtgaaattatgttaaatacatatgtttagaagatacaatgcaactttctagtttttatttccactgtaactaacttcaactatgaataaaattctacataagtttccatctcaggatttttgttctctttaaaattacaaaaactggccgggcatggtggctcacgcctgtaatcccagcactttgggaggccgaggcaggtggatcacctgaggtcaggagttcgagaccagcctagccaacatagcaaaaccccatctatactaaaaatacaaaaattagccaggtgtggtggcgggcgcctgtaatcccagctacttgggaggctgaggcaggaaaatcgcttgaacccaggaggcggaggttgcagtgagccgagatcgcaccactgcactccagtccgggtgacaagagcaaaactccgtctcaaaaaaaaaaaaaaatttacaaaagtcatttagaaaatgtatgaggccagacgcgatggctcatgcctgtaatcccaactctctgggaggccaaggcgggcggaccactaggtcagaaattcgagaccagcctgaccaacatggtgaaaccctgtctctactaaaaatacaaaatttagctgggcgtggtgtcgcacgcctgtgatcccagctactcaggagactgaggcaggagaattgcttgaacccaggaggcagaggttgcagtgagctaatactgtgccactgcactccagcctgggcgacatagtgagactctgtttcaaaaaaaaaaaaaaatgcatatgaaacacaaaaagctgggtgtggtggctggctcacacctgtaatcccagcattttgggaggccaagggggtgcggatcacctgaggtcaggagttcgagaccagcctgaccaacatggagaaaccccatctctactaaaaatacaaattagccgggcatggtggcgcatgcatgtaatcccagctactcaggaggctgaggcaggagtatcgtttgaacctgggaggcgaaggttgccatgagccgagattgtgccatcacactccagcctgggcaacaagcacgaaactctgtctcaaaaaaagaaagaaacacacagagttgccaatgtgaaaactactcaataagatttaataaaaatactgtatttggaaaaaatctttttttttttttagctgggattacaggcgcccggcatcatgcctggctcatttttgtatttttagtagggaagaggtttcaccatgttggtcaggccgatctcaaattctagacctcaggtgatccacccacctcagcatcccaaagtgctgggattacaggcgtgagccactgcacctggccttaactatttttcattaaggtaatgaaataagttaacttctcaatactttctttctttttttttttctttttgagacagggtcttgctctgctaccaggctagagtgcagtggcatgatcacagctcactacagcctcaatctccaaggctcaagcgatcctccctcctcagtctcccaaacagctgaggcaacaggtgcataccacatgcagctaattttttatttttttgtagagacaggatctcaccattttgcccagactgattttgaaatcctgagctcaagctatcagcctgcctcagcctcaagtgctgggattacaggtgatggcatccggccttcaatattttctggatgaaagagaggacttattactagtcctagattattatgaaaaacagcaatatcatgattaaaattttgttcctcctcccagtactgtgttctattaattagataggaaataggaatgaacaaaaatagacattaaatcaaatgattttactttctaaaagtcaaaaattctaatgctttgtttacctatctacaaatatttatcttactacttctataaataattgaataaaatcttaaatgaactaaaagaaataatgggacttttcactacacaaaagataattacctatacaatgaaatgaggtgaaattcttagagcaaatatgtcatacaacaagcttaaattaatgatacgaaacagttagaatgcccccaccccaataaaccatggacaaaacacgactgggcaattcgcaagaaatacaagtaataaaattcaaaaaaaggctgacgcggtggctcatgcctgtaatcccaacgctttgggaggccgaggcgggtggatcatgagatcaggtgctcgagaccagcctggccaacatagtgaaaacccatttctactaaaaatacaaaaaaatagctgggcgtggtggtggatgcctgtaatcccagctacttgggaggctgaggcaggagaactgcttgaacctgggacgcgaaggttgcagtaagccaagatcgtgccacggcactccagcctgggcaacagtgtaagactcaggtctcaaagaaaaaagaaaaagaaattcaaaatattcattagtcctactaatcaagtaagtaaaagcttagaactactttttttctgttgttaagataaagattttaatatatcatacatgacaaaggtttgataaaactagacctatcacacattgctaatgacattacaaattgatgcaacctttttagggagtggcatttcaaaactttaataaaaataagagatcagggctgggcatggtggcttatgcctgtaatccaagcattctgggaggccaaggcaggggagatcacttgaggtcaggagttcaagaccagcctggccaacatggcgaaaccctgtatttttagtattctactaaaaatacaaaaattagtcaggcgtaggccaggcgcgatggctcacacctgtaatcccagcactttgggaggccgaggcgggcagatcacgaggttaggagatcgagaccatcctagctaacacggtgaaaccccatctctattaaaactacaaaaaattagccgggcatggtggcaggcacctgtagtcccagctactcgggagggaggctgaggcaggagaatggcgtgaacccaggaggcggagtttgcagtgagccgagatcacgccattacactccagcctgggcgacagagcaagactcatctcaaaaaaaaacaaacaacaacaacaaaaaattagccaggcatggtagcgcgcctgtaatcccagctacttgggaggctaagacaggagaaccgcttgatctcaggaggcggaggttgcagtaagcggagatcatgccactgcactccagcctgggtgacagaacaagactctgtatcaaaaaaaaaaaaaaaattcaatgtaatttaaaaaaataagagatcaagccgggcacggtggctcacacctgtaatcccaggactttgggaggctaaagcaggcaggtcacttgagacaggagttcaagactagcctggccaacatggtaaaccttgtctctactaaaatcaaaaaattagccaggcatggtggcacacgcctgtaatcccagctattcagggcgctgacacatgagaatcccttgaacctgggaggcagaggttgtggagagccgagatggcaccactgcactctagcctgggtgacacagtgagacatcatctcaaaaaaaaaaaaaaaaaaaagagtttatatttatctcaaaaaaagagtttatatttattgcttgctaaggcatcaaatataagaaggaaaaaattttaaaaagttcgtatttactaagaacttactaagtaataggcacagctcactgcaaccacttcctcccaggttcaagcgactctcctgccacagcctcccaagtagctgggattacaggtgcccaccaccatgtctggctaatttttgtatttttactagagatgggtttcaccatgttggtcaggctggtctcgaactcctgacctcaggtgatccatccacctcggcctcccaaagtgctagaattacaggcatgagccactgcacctggcctctagcggctttcttaacacatataccctctttaaatcttttaataatcctgtgacaaagatgttattatcatccctattttataggtaacaaacagatacagattgaacagcttatacaaagtccaacaactagaaagtgataagaccagaatttgacaataagcaaatagacattagagcctatatgcttctgaatatctatgaagaatcaaaaaatgcttttttgttgttgttgttgttgagacggagtcttgctctgtcgcccaggctggagtgtagtggcatgatctcggctcactgcaagctccgcctcctgggttcacgccatcctcctgcttcaacctcctgagtagctgggactagaggcgcctgccaccacacccagctaattttttgtatcttttagtagagacggggtttcaccacgttagccaggatggtctcaatctcttcacctcgtcatccacccacctcggcctcccaaagtgctgggattacaggcatgagccaccgcgcccaccctctttcttttaaaaaaaaaaaaaaaaaaaaagatggagtctcactctgtcacctaggctggagtgaagtggcacaatctcggctcactgcaacctttgcctcgatactccttccttagcttcccaagtagctgggactacaggtgtgcgccaccacgcccagctaatttttgtatcttagtagagatggggattcaccatgttggccaggctggtgtcaaactcctgacctcagatgatccacccacctcagcctcccaaagtgctgggattacaggcgtgagccaccatgcccggccaaatgcttattttttaacctaattatcctgcctatggtaatctgtcctataaaaataaccaaaatatgaaaaaggctttatctacaaaaaggtcagccagagcattacacatagtaacaaaaggcagtagggtgagaagaggaaaaggggagacagctgtatggttacataaattatagtgtggttactcagttttttgttgttgttttgagacagagtctcgctctgtcgcccaggctggagtgcaatggtgtggtcttggctcactgcaacctccacctcccggattccagcgattctcctgcctcagcctcctgagcagctgaagactacaggcgcatgccaccacacctggctaatttttgtatttttagtacagagggggtttcactatgttggccaggctggtctcgaactcctgaccttgtgatatgcctgcctcagcctcccaaagggctgggattacagtcgtgagcgacagcactcagccctcagttttactcaatggaaaattaagcacccttcaaaaatgttataaaagattaacaatacggaaattttcttttacatgttacaagggaaagtaggttacaaaactctaaatgtacataagtagtatcacaaaaaaaaaaaaactgtgtatatgaaaaaagtttgaaagagaataggtcaggctgggtgtggtagctgatgtctataatttcggcactttgaaaggccaaggtgggaggatcacttgagcctaggagtttgagaccagcctgggtgacatagtgagacgactgtccctacataaaaagatttgtttttcatttaaaagaaaaaaaatagactgggcatggtggctcatgtctgtaatcccagcattttgggaggccaaggcaggtggatcacaaggtcaggagtttgagaccagcctggccaacatggtggaagcccatctctactaaaaatacaaaaaattagccgggcatggtggcagacgcctgtaatcccagctactcaggaggctgaggcaggagaatcacttgaactcgggaggcggagattgcagtgagccgagatcatgccactgggctccagcctgggcaacagagcgagactctgtctccaaaaaaaaaagtgggggaaagaaaacatttacatttataacaacatcaaaaacaatgaaatacttaggaatcaatttaacaaaaaaagtacaagacctgtgcattgaaaattataaaatactacaaacaaattaaaggagatcagaaattatacttcatttgatacttaatcacatgcaaaaaatcattagttccagttttacagttgttgccggttatttttctaacacagatacaatgtcatacctctgtttaacatcttcaatggctccctattgtttacagttaatattcaaaatgcccaatttactttcccttcctcatttcctcccatattggactgtagtctcttaaaaagcaaaggtcagggtcagacacacctggattcaaatcctgactcaatcacttacaagctatataaaaattcatctttcatttgtaaaacgtactaatgattcaaccccatgtgatcagtaattatcaaaaaggtaacttctggtaagcactagtagtgcctaacacataatagccaggtactagtttctcactcccctttttctcttcggtaaagtctgttttcatttttaaacactcaacaaagatgtcttctttcttcagttcctctgagataagttcttccttctctaagcttcctcagcactttctgaaatctattgtaaaatgtgtcatttgcattatactttgcactgagttaccagaaattgaaggtagggatcttgccttattttggtctctccactgtataatacacagcagattctcagtatttgattttgcctaacatcctccttgggtgattaacagagaacaaataggaaaagcaaatctgactaagaataaaccatgcttcagaaatgtactttgaaaggaagagattttaagtcacctataatctaacacccacaccgatctgtgatgaacacatagcatgagcaagaaatgaacctttgtgactgatgccactaagaattgggatcctttgtcaccgtaacatattctgtatattctgatatacacattaaaggagtttagtatttatctgcatcatccctatctccagtgtttggaatgttctgcacaaagcgggaacttctgcacagcaaaagagattatcaacagagtaaacagacaacctacagaacgggagaaaatatctgcaaactatgcattcaacaaaggcctggcctggctcagtggctcacacctgtaatcccagaactttgggaggccgaggtgggtggatcacaaggtcaggagatcgagaccattctggccaacatggtgaaaccccatctctactaaaaatacaaaaattagctgggtgcggtggtgcacgcctgtagtcccagctactcgggaagctgaggcaggagaattgcttgaacccgggaggcacaggttgcagtgagctgagatcgcaccactgcactccagactgtaacagaaagagactccatctcaaaaaaaaaaaggcctaatatacagaatctgtaaggaacttaaatcaacaagcaaaaaactagcattaggagatatacttaatgtaaatgacaagttaatgggtgcagcacaccaacatggcaccttgtatacatatgtaacaaacctgcaagttgtgcacatgtaccctagaatttaaagtataataaaaaaatagtttataataaaaaaaaaacaagcaaaaaacaaccccatttaaaaatgggcaaagggcatgaacagacacttctcaaaagaagacatatgtggccaacaagcatatgaaaaaatgctcaacatcacttatcattagagaaatgcaaatcaaaaccacaatgagataccatctcacacaagtcagaatggctatgattaaaaagtcacacacaaaaaaaacatgttggcaaggttgtagagaaaagggaaggcttatacactgctagtgggaatgttaattagttcagccactgtcaaaagcactttggggatttctcaaagaactgagaactaccattcaatccaggtatcccattactggatatatacccaaattaatagaaatcgttctaccataaagacacacatacacatatgttcatcacaggactttgcacaacagcaaagacatggaatcaacctaactgcccatcaacagcggactggataaagaaaacatggtacatatacgagacagaatactgtgcagccataaaaaaagaatgaaatgatcctttgcaacagcatggatgcagttggaggccattattcgtaagcgaattaattaacagaaagccaaatactgtgtgttctaacttccaagtgggagctaaacactaagtacatgtggacacagaggggaccaagagacaccaaggcttactcgagggtggaggctgggaggaagttgaggatccaaaaactacctactgggtactatgctcactatctgagtgacaaaatgatttgtgctctaagcctcagcgacacgcaatgtgcccatgttaacaaatctgtgcatgtaacccctgaacctaaaataaaagctggaaggaaaaaaaacaagtgggaactcaggtttattagaaaactttaaaatatggaatgaatgtaggacatttttaaagagaatagtcaaaggttagcagaataaccaaatgttttcaatgaaaagattacaaaagttgaagtaaccacatttttaaaaagcacagcgttagcatataaatgggagcatgcttttactctcctcttcacccaaaatacatacttctactacttcctcaccatgctgaggtcaaaaactggaggcttagggctgggcgcagtggctcacacctgtaatcccagcactttgggaggacaaggcaagtggatcacctgaggtcagtatttcgagaccagcctggccaacacggcaaaacccagtctctactaaaaaaaaaaaaaaaaaaaaattagccaggcgtggtggcagatgcctgtaatcacagctactagggaggctgaggcacgagaatcgcttgaacccaggaggcggaggttgcagtgagccaagatcgcatcactgcactccagccacgcgacagagcaagactctgtctcaaaaagaaaaaaaaagaaaaccctgggggctcaggattcaacaaagcattgttgaaagcagtcactaccaatcaaccgggcctcaacatgaaattatctgccatcgcaagaacttcagtatcataattctcacacatgagaaaattaggcctatggtgataaaccaattgctcaaagtggtaaagactatttactagctatttctgtaatatttattcccaccatcagtaaccagactttgaacctattctaagtagcaaggtactcatctaaaaaaactacattcccaaccaggcgcagtggctcacgcctgtaatctcagcactttggaaggccaaggcaggcagatcacgaggtcaggagatcaagatcaacctggctaacacggtgaaaccccgtctctaataaaaatacaaaaaattagccaggcatggtggcctgtagtcccagctactcaggaggtggaggcaggagaatggcatgaacccgggaggcggagcttacagtgagccaagatcacaccaatgcactccagcctgggcaacagagcgagactctcatctcaaaaaaaaaaaaagaaaaaaagaaaaaaaaactacattcccagccgggtgcggtggctcacgcctgtaattccaaaactttgggaggccaaagcaggtggatcaccagaggtcaggagttcgtaccaacctgaccaacatggtgaaaccctgtctctactaaaaatacaaaaattagccaggcttggtggtgcatgcctgtaatcccagctacttgggaggctaaggcaggagaatcgcttgaactcgggaggcggaggttgcagtgagccaaaatcatgtcattgcactccagcctgcatgacagagcgagactctgtctcagaaaacaaacaaactacattcccagcctcccttgcagctacaggtagccatgtgaactctgtgatagttctagccaattatatgtaagagaaaacatacaatatttcttcaaaggaggaggctgtgtgcccttggactcctttctgtattttgcttcatgggacatgcatgtaatgtaattgggactttagtagccatcaaggaatcttagggcaaaggccacaacctagaaatgtctgagaagttagataaagggagacactcctgatgactttgcagtgtagagggacaataccagcctcagtacctaccctccagattttgaagtgaaacagaaataaacactcctgttcaagtcattattattacggggttttcaatcacataaagacaaacctagtccttactgatatacccggctgttaagaattggcccagaaatagaaatcagttcttctgtcaagagtccaggatgctcaaatatataaagatctctgtacaagtcaacaaaaataaataaataaataaactatatcctttttagggttgatattcataattgttttatctttctattctgtatgacctaactatagcccaatctacactgtgacaattccatttttaaatactatttaaagtcctcaataataaaaatctgtatttcaaaatactttagaaaaataaagggtaaggttaaggagaaacttcatttaactatttcagtaaaagaggatggaaaataatgatttttatcactcgtatcccaaatgcattttttttttctgagaccgggtattgttctgtcacccaggctgggtggggtgcagttgcaggatcatagctcactgcagcctccaactcctctgctcaagtgatcctcccacctcaacctcctaagtagctgggactaaaggcatgtactaccacacccagctccaaatactctttgttcttagcgtcccttaattcagaaaactatctgcttccagcaaaacagattaaaacaaccagcattttacttatttatgatttcgtaacctggactgagcttagctaggtggttcctctgttaatcttttttttgtgtgtgagagagagaaacaaggtttcactctgtcgcccaggcttgagtgcaatggcaagataatggttcactgcagcctcaccctcctgggcttgaccaatcctcccacctcagcctcctaagtagctaggactacagagacatgccaccacactcagctaatttctgtatttttttgtagagacagtgtcttgctatattgcccgggctggtcttgaactcctgggctcaagtgttccacatgccttggcctcccagagtgctgggactgcacagtcataagcccccacgccggccccttcgctaatcttactaatcacttttgtgtctgtattcaacaggcaagtcaactaagggctgaaggcagctaggacactgagatagttaagcctccctctttccatatagtcctggaatctcttcctctccacatcatctctccagcaaggtatgacagcttcttgcacggcagcaactcagagctcccaagagtacaaaagtagaagctgcctgacatgctcaaggcttgtacccaaaaatagcaaagtgtcatttttgctatgttctactggttaaagtgagtcacagggctaggcgagatacaaagagagatgactatacaatagcatgaatacccataggcatgatttactatgggtctacaccaatacagtagactaccatctcctttatttactgtaaaagtaacaccttaatatatgacttctagtattccataatctctctggggctcagttatctataaaatgaggggttagactcaatcttcttgaattctcatctattaatagttctaatattctacaactctataagtatgaaagtctaatataagaaacacttagggccaggcacagtggctcacaccagtaatccctgcactttggaaggccaaggtgggtggatcacctgaggtcagaagttcgagaccagcctggccaacatggtgaaaccccatctccattaaaaatagaaaaattagccaggcgtggtggaggggcgcctgtactctcagctactccggggtctgaggaaggagaatcgctggaaccagggaggcataggttgcagtaagccgagatcgtgccactgcactccagccagggtgacaagagcgaaactccgtctcaaaaacaaacaaacacttggccatactgaccaaacacttcaactatggtagaacaattcaatgagaactttaagaatatggttatgtttcattttgtcattttatattcaactatgtgcttattccaaatgtggtccatatgactagaatcccaaagatcaggaaatcaaggaaattctttttttgctaggctccactaaaagaacaccaccacacagacttcactgagaccatcaagtatgctgcttctaatgtaaatcgattacaataaggtgtaaagatttaaagtgaccaaggataaaagatgtaagaaatcattttaaaaccacctaaaacaagtctcactgagggaggcctactaataaaaccctagccagtagagttataatatgtaaaaatctactctaacaacatttaaaagtttgagcaataaaaaactttggaataatattactacatatacaactcctagggaattgctttgactgtttttcgtgtattgctcataatgaaaaacatttcatagagatttctgctgacctagctttttaaaaatctttcttctatatattggggacatctgcgtacaaagaaaatctttgccaccccactatccccgcctccaataacaactgcattattttatgtcatagtttttttttttttttttttttttgggagatagggtctcgctctgtcacccaggctggagtgcagtggcatgatcacagctcactgtagcctccaactcctgggctcaagcaatcctcccatctcagcctcccaagtaactggagctacaagtgcataccaccgcatccagctatttttaattttttgtagagatggggatctcactatgttgcccaggctggtctctaacgcctagacttaagcaatcctcccacctttgcttcccaaagcactgggattacaggtgtgagccaacatacccagccttatatcatggcatttttggagtgagtttggtttctaatcacttctgtctctaaatagtttataacaggcaactgattgataattgatgattagtggcaatgacagtaacaacagtagttaaatccttacaacagcacctcttaataggacttagtctatgccagaaactgttctaaattctacacatatatataaattcataacaatcctaaattaggtgtattattacgtcctctctacaggtgaggcaaccatagcacaaaaaatttaagtaacttgcccaaggtcaaacagctaatatgtagtacaacctagacttgaatccagaaggtctaggctctataatcagtgatgcccccagaatttggttttctcatttgtcaaatgatttaccatttctgaagtattaagcttttttctttttttaaatgcataaatgtatactgaaagaatatactccccagagtttttttttgttttgttttgttttgtttttgagacagagtctcactctgtcgcccaggctggagtgcaatggcacgatttcagctcactgcaaactctgccacccaggttcaagcaattctcctgcctcagcctcccgagtagctgggattacaggcgcctgccaccatgactggctaatttttgtagttttagtagagacggggtttcaccatcttggccaggctggtcttgaactcctgacctcgtgactcaccctcctggcctcccaaagtgctgggattacaggcgttagccactgcgcccggcccccagagtattaatatttattatgtattcttcccaatctttttatatgcacaaaatatacacacagtttgggtttatgtgcttttcacaaaataaagttactgctaaacttactgctttacaacttttggaaaggtttttctctagttcaacaatgtatcatagacattctcccacttcagggcccacagatctatctctatgtcttgatttaaaactgcatggtagtccattgatgcatattttgttgttgccaacttttctctactactaatactgctgccatgagcatcttgtatgtatatgttgtccatttgtcatgagaatatattctgatttcctttcttgtttttccgggtataactggtcccctatctcctaagggcaacaaagcatcctaatcctttactaattcccatacgccatattctcagtgattacatgttaagtcacatctttaaatacttatcctaatcgattcctcaactccagtcctacttccccgaatgcttagcaggcatccaatctatttggatgcctgctacaacatctatgccagaaactgccgaattcctcctttgcagtgactggaatcttcctccccattcgcactaccaacattctatgctttggcttgatctctcacactacaactattgtaacagcctattatctctgcctccaggtaactcctgtctccatattattaccacagtgtttttttaataataggcatcattaaatcaccaagtatttgagtgcctacattcaaatgcataaatgctaaacagaatacaaagtaatttagtaaggttcctatcctcaagaatactgtaaatacctgctttgaaaactttcatttaaaaaataaaataactgggcataaagcagagattgagacctgtagtcccctggtggtccgcagattaaacctagcctacaaagtataggcgcaaataccgttttagattctaattaatgaaaaacacttaaaatccaagtttaaaaatcataaaaagggctgggtgcggtggctcatgcctgtaatcccatcattttgggaggctgaggcaggtggatcacctgaggtcaggagttcgagaccagcctggccaacatggtgaaaccccgtctctactaaaaatacaaaaaaaaaaaaaaaaaaaaaaactagccgggcatggtggtgggtgcctgtaatcctggctactcaggaggctaaggaaggagaatcacttgtacccgggaggcagaggttgcagtgagccgagatcacaccattgcactctagcctgggcaacaagagtaaaactccatctcaaaaaagaaaaaaaaaaatcataaaaatccaaatttccgccctcttgaaaaatctagaaacagcatctcaaatagcaaccatcagccagaattctgtatcagtttcaccttaagcagggcataaggactcctagacttccccaaggctgttattatttcccattttctccccaacccaaggtctaaagtgtcagttgtcattcagattcttagaagcagcctactgttcatttaaattgcttacctgctccctgtaaacagtttataactcctggactacaggataaagcccaaactcatgagtctggcattcaagaactatcacagcttggcctcaccactacacacagcctctgttctagtcacacagtcagaagccaccccaccttttacacctccttccctcaataatttcattcacattgctccctcacacactcattttcttgtcattctacttggctaaatcccaccaatccttcaaggtctaattcaaatactacttcctccaaatctttgagcacccctctaggccacaataaatcttccagggttgactgttcatcccaggacatatttagcactttgtagctctttaaataacatgtaccaaatgaaagatctaaaaagttacatagaagtatagaaaacttaagacttgttaaacaattttacacttgtagatcatatgtagttactgccatcacaaaattaacagcagaaacaaagtgaaacaattttccttttacctgaggctttttctagaatattacaaagtgcaaaaagagctgtgtcatttgtttctctcaacttgtgctcttaagtccttcaaattctgcaaataaagggatcaacacttccaattataaatccaagattggtctattacttttttttttttctttttgagacagagtctcactctgtcgcccaggctggtgtgcaatagcatgatctcagctcactgcaacctctgcctcctgggttcaagcgattctcctgcctcagcctcccgagtcactgggactataggtgcctgccaccacgcccagctaatttttgtatttttggtagagacggggtttcaccatattggccaggctggtctcccactcctgaccttgtgatccgcccacctcagcctcccaaagtgctgggattacaggtgtgagccaccgtgcccagcctttctattacattttcacagataaccaccagcatatatctacaagcaatagctataataaaaaaagaaataatctcagccgggcgtggtggctcacgtctgtaatcccagcactttgggagtgccgaggcaggcagatcacctgaggtcaggagtctgagaccagcctggccaacatggtgaacacccatctctactaaaaacacaaaaattagctgggtgtggtggcatgcgcctgtaatcccagctttttgggaggctgagtcaggcgaatcgcttgaatccggagggcggcagccacagtgagccaggatcacgccactgcactccagcctaggcaagagagtgagactgtctcaaaaaaaagaaaaaaaaaaaaaaacagaaatcatctctattctacttcgtaacttttgccacttatcctgccaacaagttctcaaaataaccactgtagcacaaacatgataaagaaaatttttaaagagaaaaggaagagattaatcagctttctgaaattaaaagataaaaatggaccaaaacaatatagaaaaaaaaaagtaaaggcaaacacaaactcacacgctgactgtaaagtttattccatggcagctaaaagttgtttggcccaaacatctcacagattaaaaactaaatcacaacctaacgagggtatctaacacgtccccaccaggcaagagtgcagagagaccatctaatgttcctatttatttagagagtcttgctctgtcacctgactagagtgtagtggtgtgatgtccgttcactgcagcctcaacctccaagcctcacacaatcttctctcagctcagtctccagagtagttgggactacaggtgcctaccaccacacccagctaatttttttgtagagacaaggcctcactttgttgcccaggctggtctcaaactccttttaaatgaggattaagtgatcctcctgactcagtctcccaaaagtgctgggattacatatatcagccaccacacccatccttaatgtcctttataactggaaactgaccaattttcaccttggaaggtcaatgaagtttcacgaagcccctccatcataaacttaaagtgacttaagtttacagagttggacaaccactatctacccagagaaacctgactgtggtctgggaaactttgcagttttgcggaacagaggaatgagatgaagcagtgtggcttgtcacttggcagattaacaacaattctggcattatggaattaactgaaatagtacgaaaatgtaataaatcacaagtgtcagaatgggaaaacaaattgttgtgatacttttatatttccatggaaatccatgtttatcaagtttacatattagtaaccaatatgtaaattggtaagtttacatattagtaactaatatgtaaatttatatattagtaaacaatatataaatttgtataatagactaaaaataacatcttctcaaatattagaaattccctgggccaggtgcggtgtttcatgtctgtaatcccagcactttgggaggcccaggcaggcagatcatgaggtcaagagattgagaccatcctggctaacagggtgaaaccccgtctctactaaaaatacaaaaattagtcaggcatggtagtacgtgcctgcagtcccagctactccagctacttgggaggctgagacaggagaatcacttgaacctgggaggcggaagttgcagcgagccaagatcgcaccactgcactccagcctgggcggcagagcaagactctgtcaaaaaaaaaaaaaaagaaaaaaaacaggttcttattcatgggaatttcaggtcaggttaaacaacaacctcctaacaggtaagagagggtagcaatcctgagtcaacttttcaactgaattaaaacatttcagtgcctattgagtcccagagaccaataatatcaaaaattttatcagatctcttggacaataaattattaagaattgctgtcataaaaattacaaatttgcattatctcaaaaagcatgaataatagtgctgtctctcaactataaacttgttttattaaatggtatatattgtaatgcagtacagttttctatcacttatttcaaattcacagctatgaaaaggagaaattttgttgggggaagggcgttacaaatacagagtagcaacctagccatttttgctggtccttgtaatgacaatcactggttgtgcctaatttttctacaacaataatgcttaaggtggctctctaataatagcaattgccctctgaaaagaaagtggttcagggtataaagagtttactcaaaaaaggccaaggatagtgcttcagaaatcctatacctaccacctgctgcttctgtacaaccacccccatcccccacacccacacccatttctaacatcaactttcatgaactggtaagaaacatagtagagtagaatgtttctttggcttcccaacttggtaatgtgaatttacagtgtaaggatggaaaaaataagaaaaaagcttcagaaaaattttttaacattaacacaaaaataatgagatctttaatatgtgcatattctgacagaggcctgccaatggttaagacctgtgcctctgataaagatgatgaactactccaaattatcaaataatttgatactttttacagttaaggaaaactttcaaatgaatgtaaatttcactgtgccacttgacatttgtacaataggaaacctctatgtatttacttttccaactctaagattaatagcttcagttcaagtttcttgattttaggtagtaaaattttaagatatttatagttaatgtaaaagcagtaactatatagctatgctttttattcatgacaaaatacacaaaaacaatctagctaacactataagacaagaaaatgctttatttacctaattattaaaaatttaaacttgaggaaagtgtaattggtggtgcatgtttttttaagccaaagataaatacataaatccacttcattgtcaaaaggcatcttctcagcggggtgcggtggctcacgcctgtaatcctggcactttgggaggctgaggagagtggattacctgaggtcgggggttcaagaccagcctggccaacatggtgaaaccctgtgtctactaaaaatacaaaaaattagctaggtgcgatggcgcacacctgtaatcccagctactctggaggctgaggaaggagaatcgcttgaatacacgaggcagaggttgcggtgagccgagatcataccactgcactacagcctgggctacagagcaagacttcgtccagaaaaaaaaaaaaaaggcatcttctctacttaatgtaactcactaagttaatgaacatctaagtaacattagcaacttaaaatatctctatgagatttagcaaagaagattaattttcatttctcaggtgaattatttgcaatttcacataatttcactggttacaaacctaatttacactggttacacataagtttcactttcagggtctttactgtccaactacagggtcttttctgcatggattcttatacagtatagagatacacaattcaaaaacctctttgctttccaattcatatgttagtttccatttacatgttgctaaaaacaactggagattccattcccttcaaaagacacaatttcaaaaaaaacgctctaaaaagtttagacccgtcaaatttaccagtagactttaatttcctataaagaaagcagtactagttttcaaatctaaaagaaaaagctctctacagacttacatttgttctaaatatttccaaaagttttgatttttcatagttagattatactgttattcagcagaaattttttatcttctccaaaggctgcctatttcttcatgagattcagaattaaaataataaagtggcaataccctaatcgtccagtgcactcaggagctgcactaatacaaatgagctcatttcaaaagtagggtgtgtgcgagtgtgcgcgtgcgtgtgagtgtgcgcgtgtgcgcgtgcacaagcacgcccttacaggagtatggggtgtggggtgtgacaacatagatctaatctttctggagtaagaattcaaatgcaaatttaaaacaatacttgcaaattaatgttcagtaagagatgaagaaatgctttgcaaatagtgaaatgggaggcaatcaaggtaaaaccccaatatggcttgtcctgagttgctttaaaggatgcaaaaaaaagtggcttacatgtctaaaaattacttaaacctccacttccttctacaaatttcagttaatacagaataagggcattttatacttgccactgtattacaacgcaagtggcataataaataagtcctaactttgtatcacgaacaagctaatgtaataatgtacacacatcctgtacttgcttccctcacgattatcatagctaggtaacagctggcaataaaatatggaggcaagttgaaggccctgaatcattttcatagtaaaaggacagcggggcaagaaaagagcacattcaagtcaagagctcaatgggttcccacaacccagctctgctatgcctcagttcacgctactatttttactacaaatcaccaaacaacaatactattactaagtgaatgcacccgaaccaaagaaacagcctatccataaacgtgctggcttccttcacgtcccagcgcacccttccactcccgacagttcaatgagaatatcatctcacgaaatgagtaagcacacacgccattctacaacttcgagagacattcacagttcttccacggcacacgcgagagccacagaagccgagcagttcgctggcactaaaacggtgtcttaatttacaagcaaagccgtcaaataaccgttctgtaagaagacatttctggtcctctaataagctggggtccagccctactgtacgctcaaaggcaggcgaccctattcccaagccccttacagctaagacttacgagggaagcgacatttacatctgcactctctccgaataagtgctcttggtattctgccttacgaggggacgctggctacgtctccaaaacttaggcaggccgttccccgaagctgggggatcccacaggacttgtgctttcggagcccgggagtgcggtgctgggtgttgggggaggggggaggaagaagtcaaatggcttcctaatatatcatcaaaagaagaaaacacaggtttgggaccaggaaaagttccaggagcaagtcgctgacaaacaaaagctgcactcgcccggccgctttcttctcgcccccagcccgcgccccgagaccacctggcccgggcgttttgacagctccgagagtttcccgagcgccgacggctcggcggttcgcccggagtccgtccggggactacctgggcgcgctccgggcttgttttctcaatgatccagctaggccaagacgcggctacgagaaatttctccaaaagaagagtcgcggagaagacccagtgaaaaggcccgactgaaaagtaaagtgtgcggagccgggcgccggcgggagcccgggcgggcggcgcggagcgggggaggccgggcgcgggcggctaccgaggggcgcggggccggggccgggagccgccaccgcccgcgggcccgccccgcccccaccccgccggggggcgccggggcgcggaggccgcggggcgggcgcccggtgacagctccggcccggcgccgccgctggctcccggcctggctccctcgcactcaacttacttctttctggctctctggaaaggggaagcgccatctttgcgaggccggccccgaggtcttttgtctgcggctgcggggctcggggccggggctccaggctcctcggggggtggtggcggcggctgcggctgctccacgctcttgtcctcctccgacgacatcctagtcaccaggaaagacacatggatcccggtcctcctcctggggggctcccgccgccgcggccgccgccgccgccgctgctgctcgggttcctcctccccggctcagcctctcgcatttcccgcagccccgggagcagcagcaggtaccgggagaggcggcaacatggagcgagcaggacacgcactcacacacatcggcgcgggcgcgcgcacctccgcgcgcaggggccgggcggggggcggcgggcggggcgggcggtgcggggcgggcggggccggcgggtgcgggcgggcggggcagccgggcgggcgggcggcgtgaggggcgccggcccccggggtctccgcccgcggcccctcccccgagccgcccgcggcaggaggagaaaggggcccggcgcggggagggccggccgcggggcccggcgggggcggcgagggggtcgcgcccccggccggccgcccctcccccgcgcgtcaggcccgtcaggcccgggcggcggcggcggcgaagttttgacagctgctccagtggcggcgctgggcgccgggccgcggctcgctcctcacactcgctctctcacacacgctcgctcgctctcccggagcaggggaggaggaagttttgcgggtgtgcttggaccccacacacacgccgcgcgaccgtggccgtcgcgcgaggcccgcgccggggatcccccggggcgacccgcaccacagacctctccaactcgcagccgtcgcgcccacacaccgccgcctcgacggcccccgcccgctcccccacactcggcccctcgcccgccccccgcgcgccgccgctgccactcacgggcctcgctccgcgcatgcgccgctcccgccgcccgcggacgcgccgccgccgctgacctcaccgcccctccccctcccccccgggttccctccccctgtgacgcggcggccgggcccagccgcgactccggctccggctccggctccggctcgggaggtagccaagctgtggacccagagatccgggatcgggatcggggaactgcgggcgagggcgggagggagccgcggacacacgccgaggcggccgcggtcgcccggcgcagcccggcgcgaggagcaaatgtgcgcccgcacggcgagggcagcccgggcttcgctggttctcgccgaggtctttcctcgtagcgcccacactacggggaggaaaaggaatggagtcaacttcgttcgaatccaacgccagttagtttccttattataacgtcattttttttaatccagaaaaggttcataaggatgtaagacgaaaagaacgatgacagctcgagaaataaaacggttagagacaaaataagccaataaaaacccaaccacttgattttaacgttcagtgtgttgtgatgaagaggcaaaaatcgaagtacttctaagccacctctcataatatgtaaaaatggtaaaaagaaaaatggggctagaatccgcctgaaaaatgcactttctcaagaaggacagttacaaatatgggattctggatttctcaggctaatacctaacacttggacgatgatctattctgtgctttccattcactatcgattagtttatgagagtgaaaaaattctagatttgaatggggggaaatagtaagacctatcaaccatttgtgaaggattggggtaaactatcatttaataagcatctactttgggcctagcgttaagaggcacactctcatgttgatttcttttgatcttcgcagtgtagttttagtgtaaggtaaaaaaaaataggctccttttccagcgatgtttgctttcccttctagtagctaggatgttaactttaaactgtgtcttctacttgggcaaaatacacacactttgattcccagagcctattctaaatgaaagcataattttttgaaatggctgaaatgaggaataacgtcagatagtcatttgaataccttcagggtttaatccctgctggctctttcaaatttactaaatttataaccaaaggaaatttgggattgaggaggaggctggcatggtaaatgcaaactagaaattaaaagtgcctgacgattacacatagaaatacaacatatatgtgactagtgataaacatatgatgtgatctagtgaaagtttactcagtacaaatttgaaagcaccctttcttttttcattttcttcagcacattgtactttaaataaagtgtgctttcaaaactggattattgatccaaatatttagctgtgttccgtactgaaattagaataggcacttccacggtgagtttcacatgtacaaaattatacatcaggataatttacttccatacgcttctccagcacttctgagaacttaagtgtcagtggatacaaattgcaagtcactcctgctggagagttcacaagaaacaaagggtactaagagcagaaaagtgagccgagtgaatggaagggtagaaacagaggtttgtgcagggatgcttctggatagatgatgatgcaggtaagtaaactcagcctgaaatctccattcctttggccactatgagcagggagttgggatctgttttaagagagctgatagcagtctccttggcatgaagttatcatgaacagagcaaatcaaatataacccaggatgctgaggaaggattcaaggaatacttattcaacataaataaaggttttccagaggtttttccgtctcagtcatccaaattacacagctctgagaccacagtagcaaaaatctaggaggcagggagctgaggtccttcaaaattatgaaagcaaaaaggcaggagcatctggaaacagtaccaaatacaacagaaaaatattagaatgtgtactttctaataagtatacatgttaaatatgggattttaaatttaggtagatgtgtactaacctgttaaccaatcatctgcaaaggggtgaattacaagggacttttactgtctaaaatatttgaatatttcaaagcacatgtagtaatcatctaatcatatatatatatatatatatgtagtttttaatggggagggaatgagcattgttatctttgacaaagaaaaaccaacatctcagaaaaatataggcaaggaagattctcaaagcatctagcaaacaagtgacagtgaataaaaattcatagtccaatattcattcttactaattgaaggcctataacatgtgattgtctttatttagaatgcacaggttcactactaaatgttgtctctcttgttttcccataaattcctcagggctttttaggaaccaaactttcactgttatagaaggaccactgaaagcttaaattttagatcttagaatttttgtgttcatattgttattattaaagttgcactgtaggctgggcactgtggctcatgcctgtaatcctagcactttggaaggccaaggcgggtggatcacttgagctcaggagttcgagaccagcctgggcaacatagtgagacctccgtctctacaaaaaaataccaaagaaaattaaccaggcctggctgggcgcggtggctcacacctgtaatcccagcactttgggaggccaaggcaggcggatcatgaggtcaggagatcgagaccattctggctaacaaggtgaaaccctgtctctactaaaaaagcaaaaaattagccgggcgtgctggcaggcacctgtagtcccagctactcgggaggctgaggcaggagaatggcgtgtacccgggagacggagcttgcagtgagctgagatcgcgccactgcactccagcctgggtgacggagtgagactccgtctcaaaaaaaaaaaaaagaaaaaaaaattaaccaggcctggtggcacatgcttgtagtcccagctacttgggaggccgaagtgggagacagtcttgctctgtcacctaggctagagtgcagtgatgcgatctcggctcacagcaacctccacctcaaatttgccgggcacggtggctcatgcctgtagtcccagcactttgggaggccaaggcaggcagatcacttgaggtcaggagttcgagaccagcctggccaacatggtgaatccccatctctactaaaaatacaaaaattagcctggcatggtgacgtgcgcctgtaatccccgctattctggaggctgagacaggagaattgtttgaacccaggaggcggaggttgcagtgagccgagatcgcgccattgcactctagcctgggcaacaagagcgaaactctgcctcaaaaaaaaaaaaattcatattgctatataagttatttcagtaaagtatatcatgtgcctgtttggtggaaaagttaaaggaagaaaccaggaaggaaacaagcagaacagtcatcttcaaaagtaatttgtgtttaagaatgtgaggcttaagtagatgttttgcagtacattttatatagatactaatcttgccctctaggggtctatactttaagcctggcagtagtagttaacaaggataaacacaaaaggacaagtaagcaactagaaaataaacatggaggccgggcatggtggctcacgcctgtaatctcagcactttgggaggccgcggtgggaggatcacgaggtcaggagttcgagaccagcctggccaatatggtgaaaccctgtctctgttaaaaatataaaaactagctaggcgtggtggtgcacacctgtagtcccagctactcaggaggctcaggcagcagaatcccttgaacctaggaggcggagggtgcagtgagctgagattgttccagtgcactccagcctgggcaatagaggcagacaccacccccccccaaaaaaaaagagaaagaaaagaaacatggaaaaacatacaaatagaaagattaaatatttacgtccattgtgtacaagatcatagttttaaaagaaatgcatctgtggattcagggggaagggcagcagtgggagaagtcatagcagacaaccatatctattcagaagagggtgacagaacacattctgctggcaagtatcataaactagaaattttcaggccaggcatggtggtttacatctgtaatcccagcactttgggaggccagggtaggcagatcacttgaggtcaggagttcgagaccagcctgaccaacatggtgaaacctcgcctctactaaaaatacaaaattagccaggcgtggtggcaggcacccgtaatcccagctattctggaggctgaagcaggagaattgcttgaatcagggaggcggaggttgcagtgagccaggatcgtgccactgcactccagcctgggcgacagagtgagatgctgtctcaaaaaaagaaagaaaagaaagaaagaaagaaggaagaaatggaatagacagccctattcatcaccctgcaggctgaagcctaaattccttggcttgactcactaggtcctggagagcccctgctaccctctggcgaacgtgctcatctcttccccagctttccttctcacctgaccaccagttttcagaactccttccagtgggctacaaaccaccaggctgtcccatcgcccttcccctttccacgaggccagttcctactttttcttcggctcttgctttagacctctgccctccgtgagaatggctgtgtccccctaaatgcttctgccaaccttgtgctttccccactcacagctctcattgcctgtaatgaaagtgcccagattaatgtctatattgtccctaaacccagcggagatggcagtagttatctgccttatttcccctattcaacagcagctcagtgaacagttgtagggtaactgaaatgaatatgaaaatataggttaggtgttagaaaaagagctaagaggatcctttataggagtgtttattttattttattttattttttgagacagggtctcactctgtcacccaggctggagtgcaatggcacaatctcagctcactgcaacttccaccttcagggctcaagcaatcctcccacctcagccttccaagtagctgactacaggcacacatcaccacggccggctattgttttgtatttttagtagagacaggggtcttgtcatattgcccaagctagtcttgaatgcctgaactccacctggctgaggcctcccaaagtgctgggattataggcttaagccaccgccactggccagtcgtgtttattttatttatttatttatttatttatattatttatttatttttttttttagactgagtctcgctctgttgcccaggctggagtatagtggtgcaatctcggctcactgcaatgtccacctcccaggttcaagagattctcgtgccttagcctcccgagtagctgggataacaggcacccaccatcacacctgcctaatgtgtttatttttttaaaaaaagaaactgtatctttagagaaaatgtatacatgcatactttgctacatttttgttgattgttacattttacatttgtataacaatacaggcaagtcatctttgcactcataaccacatcttttatggaacatcaagcctactctgaggtacaggctttcagaagcctgaatttggaggaccatgcctgaaccaaatggagtctccagaatcaaaactgctcaaaataatcattcatggttctcagaccaaataagatctacttagaaacatttctcgacagcacgctgccatgccgacgcagaccccactctgcacgccagcccccctgcacccaccatggccacagttcagcagctagaaggaagatggcgcctggtggacaacaaaggctttgatgaatacatgaaggagctaggagtgggaatagctttgtgaaaaatgggcgcaatggccaagccagattgtatcatcacttgtgatagcaaaaacctcaccataaaaactgagagcactttgaaaacaacacagttttctggtaccctgggagagaagtttgaagaaaacacagctgatggcagaagaactcagactgtttgcaactttacagatggtgcattggttcagcatcaggagtgggatgggaaggaaagcacaataacaagaaaactgaaagatgggaaattagtggtggagcgtgtcatgaaccatgtcgcctgtactcggatctatgaaaaagcacaataaagattccatcatcactttggacaggagttaaccaagagaatgaccaagctcagttcaatgaacaaatctccatactgtttctttcttttttttttcattactgtgttcaattatctttatcacaaacattttacatgcagctatttcaaagtgtgttggattcattaggatcatccctttggttaataaataaatgagtttctgctaaaaaaaaaaaaaaaaaaaagaaaaagaaacatttctcaggccgggcacgatggctcacagaccaggcacagtggcacacacctgtaatcccagcacttttgggaggccgaggcgggtggatcccctgaggtcgggagtttgagaccagcccgactaacatggagaaaccctgtctctactaaaaatacaaaattagccgggcatggtggcacatggctactccgtcccagctactcaggaggctgaagcaagagaattgcttgaggcagaggctgcggtgagccgagggtgagccaagatcgccccattgtactccagcctgggtgacaagagcgaaactccgaaactccatgtccaaacaaaaaaagaaacatttctctgagccaagataatgttgagaaggaaatgattacagaatagcatatatgtatcataatcttatgtaacatggtgtaaatctataattatgtatgcatacaatatgtgcaaagtagtaatgttcatcaagttgtaaacaacggttatctctgaactaggattccaaatgacctttccccttttttttttgagacaagtctcactctgttgccccggctagaatgcagtggtgcaatcatggctcactgaagcctcaacctcctgagcttaagcagtcctcccgcctcagcctcccaaagtgcagggattacacgcatgagccaccacacccagactaaatatgtgttaaactaaagcagaagcatcattacccgagtaggctctataggaagaaagaggagacgagtgaggaaaggagagagaatgaaaaaaagagacttaaattgtaagcattgaaggttaggatgggaaggcgattcgcatttaaacctcagggccccatttaggcttctacctccctgaccgctgggaggctggttgcttttcacccctctgggttcacttctatttgtctgtgagctgtcagcatccttccccgcttgtcttgccctgcctctgccagggaggcagagttgggagtcgtggcacaggcatgcacgctgtgcagcctcccacacctgcaccctgaaagaccaacagacaccctaagaaacctgatacacaagcacaaactgataagatacccaaaaaggcaaaggcagacagatagcaaaacatggctaatattacacagtactgcaagagaaagtaacaccaaaacaaaacaaaacacagacatcgtctctcagttccttctcaaaaaaaaaaaaaaggccaggtatagtggctcacacctgtaatcccagcatttttggaggccgaggtgggcagatcacttgaggccaggagttcgagaccggcctggccaactatggccaacatggtgaaaccccccatctctactaaaaatacaaaaaattagccgggcatggtggctggcacctgtaatcccagctactgggaggctgaggcaggagaattgcttcaacctgggaggcggaggttgcagtgagctaagattgtaccactgcactccagcctgggcaacagagtgcaactctgtctcaaaaaaaaaaaaaaaaaaaaaaaagcgtgggtgtggtggtggctcacacctgtagtcctagcacttcgggaggccaaggtggaaggctctcttgaggctaggaatttgagacctgcctggacaacatacagaaaccctgtctctataaaaaataaaaaaactagctaggtgtggtggtgtgcgcctatagtcccaggtacttgggaggctgaacaggaagactgcttgagaccagggagttgggcctgcagtgaaccatggtcatgcccctgcactccagacagggtgaagtgggtagtttttcacttgatctcctccttattgtatctaacgtttaaacaagtctcagacctggtgcagaggtgcatgtacctccattgctggacaaggcctgacttttgcctgctggtagggcctcctcagttctaaccagacttctgcgacctcattctctatcctggttccattttccactttgtgacttcatcagttaaagatcccatttcagccaccaaggttgagaggccccaagacccagttcctttacagaatcaaccctggggtggctttaggactgggctctttggagctcatccttggacccacagtggagcgctggtctgtgctaacatcttcagataccaatcaatgggcatttggctccttgcttccactgacctcttgagtactttcaacgatcggtgtcaagggtgcccctgctgctgtttctagagcatctctgcaacccacggtggcctctcctctttctgcgggccatggacagcacagtcccttcagccctggagctgccccagcggctggcactgaacccaagggagagcccaaggagtccggaagaggaggagccccacctgctgagcagcttggctgcagtccagaccctggccaatgtcatccggccttgctatggcccccatggccggcagaagttcctggtgaccatgaaaggagaaacagtgtgcacggggtgtgccactgccatcctcagggccctggagctggagcacccagcggcatggctcctccgggaagcagcccaaacccaagcagagaatagtggggatggcacagccttcgtggttctgctgacggaagccttgctggaacaggcagagcagctgctgaagttcggcctgcctcgcccgcagctccgggaggcctacgccacagccactgcagaggtcctggccacactgccctccctggccatccaatctctggggcctttggaagatccgtcctgggccctccattctgtgatgaatacccacaccctgccccccatgaaccacttgaccaagctggtggcccacgcctgctgggctatcaaggagctagacggcagcttcaagcctgagcgtgttggggtgtgcacgctgcacggggggacactggaggattcctgcctcctccaggggttagcaatatctgggaagctctgtgggcaaatggccgcagtgttaagtggtgccagggtggctctctttgcttgcccctttggtcctgcccatccaaatgcaccagcaacggcctgtctttctagtcctgctgatctagctcaatttagtaaaggaagtgaccaattactagaaaagcaagtaggccagctggcagccgcgggaattaatgtggcagtggtgttgggggaggtcgacgaggagaccctcacactggcggacaagtatggcatcgtggtgattcaggctaggtctcggatggagatcatttacctgagtgaggtgttggacacaccgctgctgcctcgtctgctccctccccagaggccaggcaagtgccagagggtttacaggcaggagctgggagatggtttggctgtggtatttgaatgggaatgtacaggcacacctgccctcaccgtggttctcaggggagccaccacccaggggctgcggagtgcagagcaggccgtctaccacagcattgatgcctatttccagccatgtcaagatcccagactgatcccaggagctggggccacagaaatggctttggcaaaaatgctctctgataaaggaagcagattggaagggcccaatgggcctgcattcctagcatttgcccgggccctgaagtatcttcctaaaaccttggcagagaatgcaggcttagctgtctcagacgtggttgcagaaatgagtggagtgcaccaaggtgggaacctcctaatgggtgtgggagctgaagggataataaatgtggcccaggaaggggtgtgggacaccctaatagtcaaagcccaaggatttcgagcagtggctgaggtggtgctacagctcgtgactgtagatgaaatcgtagtggccaagaaaagtcccacacatcagcagatctggaatcctgactctaagaagacaaagaaacgcccacctcctgtggaaaaaaaaaaaatccttggaatgaataactagtgataccctcaataaaacagggattgccaagaagggaacaatcaccccaaaaatgaatgtttgcctttattccatgtttggtacttgattcagtttctttaaataaaaacatgaaggaacataaaatttcttttcatgtgcttagttcctttccagttctcgaattttttttttttttttagagatggagtcttgctctgttgcccaggctggtgtgcagtggcatgatcttggctcactgcaacctccgcctccctggttcaagcgattctcctgcctcagcctcccgaatagctgggactacaggtgcgcgccaccacacccagctatttttttgtatttttagtagagacggggtttcaccatattggccaggctggtctcgaactcctgacctcatgatcctcctgcctcagcctcccaaagtgctgggattacaggcgagagccaccgtgcccggccagttcttgaccttttcgttttctgtttctctctatcagattctcttcctttcctacgataagagcaggattcaattctattaagatttttaaactgagtacctatgtgggctttgggcatgcaaaacacagtgcagcaatctcttcccaactatttgagcattccctgcatgatattctgacatatatggacttatgtctagatgtcactttaggagtctgaaaacatcagttgcagcttacaagagtggtcagtccttcctgttgtggttatttgaaaaaaaagaagggactatcatcttaaagcacagagagagagagaaagcaggaaaaggggctgctgtgctggcaggcagaaatttaacttaaaaaaaaaaatccttgcctgacacagtggctcatgcctgtaattcctgcactttgggaggctgagacaggaagatcgcttgagtccaggagttcaagaccagcctggacaacatagtgagaccctgtctctacaaaaataaaaattaaaaaaaattagccaggcgtgggccgggcgtggtggctcaagcctgtaatcccagcactttaggagcccgaggtgggcggatcacctgaggtcaggagttcaagaccagcctgaccaacatgcagaaaccccatctctactaaaaatacaaaaaagtagccggacgtggtggcacatgcctgtaatcccagctacttgagaggctgaggcaggagaattgcttgaacccgcgaggcagaggttgttgtgagctgagatgatgccattgtaccccagcctgggcaacaagagcaaaactctgcctcaaaaaaaaaaaaaaaaaaaattagccaggcgtggtgatgcatacctgtagtcccagctactcaggaggctgaggtgggaggatcacttaagcccaggagatcgaggttgcagtgagctgtgattgtgccactgcactccagcctaagagacagagcaagaccctgtctcaacaaaacaaaacaaaccaaaaccagcaaacatccttggcatagataacagaagataagaacacataccttaggactatgctaaggttgttgtgtaggtgaggagaaagctgagggtagggggaagggctaggattggacaaccttgggcattaaagaaggggtctaagcagaggtgagtgggttcagcacctaatacccaaagctttttccacatttttaaccatccaagttaccctaggaaaagatcagaacctatgggacagaatctaggagatgagaaggtacaatctcttagaatcataaaaataaaaaagctttaggcatatgcagagagaatgagactcaagaaaccattgtcttatagcacgcatattagccgcaacacagcaaaacaaaattttatttatttatttattttgagacagagtcttgctctgtcacccaggcatagtgactggtgtggcccaggaaccagtgcagcggtgcagtctcagctcactgcaacctccacctcctgggcgcaaatgattctcctgcctcagcctcctgagtagctgggactacaggtgtccaccaccacacctggctaatttttgtatttttagtagagacggggttttgccatgttggccaggctggtctcaaactttggacctcaggtgatccacctgcctcggcctccccaaatgctgggattacgggtgtgtcccaccccaatttgctatatcttgattttgtctagaatctaagtatcctctttaatgtcatctttaagtgtccttttttttttttttttttttttgagatggagtctcacttgcccaggctggagtgcagtagcatgatctcggctcactgcaacctccacctcccaggttcaagtgattctcctgcctcaccctcccagtagctgggattacaggcgtccgccactaagccagactaatttttttgaatttttgttttttttttttttgagatggcatctcactctgtcacccaggctggagtgcagtggtgtgatctcagctcactgcaacctccacctcccaggttgaagagattcttccgtctcagcctcctgagtagctgggactacaggtgcgcgccaccatgcctggataatttttgtatttttagtagacacagggtctcaccataatggccaggctggtctcgaactcctgacctcgtgatccacccgcctcagcctcccaaagtgccgggattacaggcatgagccactgtgcccagccaatttttttgaattttttgtagagacggggtttcaccatgttggccaggctggtctcgaacccctgacctcaaatgattcgcccgcctcaaccacccaaagtgctgggattacaggcatgaaccaccaaccccagcataagtgtcctctttagttgtcaaaacatgtgactcaaacatcaagttggtttttttctcctactgactatggagaagttgaccagaatttgacctcaatttggccagatccagactcttcttctgagattacaggatcaaggtctcctagcatgctaggtctcaatcctcaaaggctttggctttggggttggctacatatttctcttccaagatgagctgcttgcttcaattccagaagcagttgaatttcagaaatgacaattcctggaggacattttctttttctttttttttgagagggagtttcgctcttgttgcccaggctggagtacaatggcataatctcggctcaccacaacctccgcctcccaggttcaagcgattcctctgcctcaggagtagctgggattataggcatgtgccaccacacctggctaattttgtatttttactagagacggggtttctccatgttggtcaggctgatcttgaactcctgacctcaggtgatccgcccgccttggcctcccaaagtgctgggattacagtcatgagccactgcgcctggccattcctggagtacattttctataagaacttgtagctggtggactcatcccagaccccttccagctttgtgacactgctttactgtgctccagcttgatctagcaaccagagaacaatagccacaatccagagaaaacgggaggaaaatgagaactgagtcctcggaaatgaaggagatgagaggctgacttggatagtggaggctgggactgagccttgggaactgctcatccatttgggctatatgtaggccagtcatggtggctcatcacctctaatcccagtagtttgaaaggccaaggcaggcggatcgcttgaggttaggagtttgagaccagcctggacagcgcactgataccccttttctacaaaaaaataaataaattacccaggtgtggtggcatgcacctgtagtcccacttattcggaaggctgaggcaagagaatctcttgaacctaggaggcagaggttgcagtgagccgagatggtgccactgcactccagcctgggcaacagagcaagactccatctcaaaataataataataataaattaaaaaataaaaattaactgggcatggtggtgcacacctgtagtcccagctactggggggggctgagatggaaggatttcttgagcccaggaagtcgaggctgcagtgagcagtgattggtccactgcactccagcctgggtgacagagtgagaccctttctcaagaaaaaaaaaaaaaaaaaaagacttcaatctacaaaaacattggagttctgatgaagagaaaaaggtatcaattccaaactgtgaaaagaactgtgaagagaagattgaaaacaaaacaacagaaaagagttgtcatagtttgccagtcctttctctacatgggccagcctcttctcatgcgtattgagttgtttctccagagtctttttttttttttttttttttttgagatggagtcttgctctgtcacccaggctggagtgtagtggtgtgatcccggctcactgcaccagtagacaggtatgacagatattccaaaagtagatgagtcaccttttcccctgaaacatcaagaatccccacccccccaacccccccccccccgccccccgccgcaggctaaagatcctctttcctaactagggaggaagaggaagaaggttagggtaagaatgagggagatggtggtagaatctctgagagggattctactcacctcccagtgggttccaaggagtgagattggggaaaggacaattagaatccgcagcaaagtttgggggtctgagaagagaggagattctctgcttccaatctggaaccctggggccccaaggagttccctgtgccaaccagacagcagagctgtagaccaggaatggctgaggcctcgggcggagatgggccccgggtagttgatgggatgttcgcggtgctgagcagcctcagagaacagccagggtcccccatgaagcagcaaccatgaagccgctgaaccttagggcatttcaaggtcatgagaaaaggtaggattgtaaactttagctgaggcttgagaaagacagaaaatgacctcagaccacaggacaccaagatgctgcatcagcccgtggactggagactaattgtggggtgaatgagagaaggaggtgaaggagaagatcaagaatggacttggttgaggtttagcctgatcaggaaaaatcataaaaggccaaagtttacctggaattgactagattaattattttaccatcaggcagaaaaaggggctagaaatagaaatactgagatgatttagttataaaagcatagcacgaatacttcccacacattgaagcgtaggacttaagaatttaaactctcggccgggcatagtggctcatgcctgtaatcccagcactttgggaggccgaggcaggcagatcacctgaggtcaggagtttcagatcagcctggacaacatggtgagaccctttctctaataaaaatacaaaaattgtccaggcgttttggtgggtgcttgtaatcccagctactcgggaggctaaagcaggagaatcgcttgagcctgggaggcagaggttgcagtgagccaagaccctgccactgcactccagactgggcaacagagtgagactccatatcaaaaaagaatttaaactctctacaaacgtgaattttctttttttttttttttttgagacagagtcgctctttcccccaggctggagtacagtggcacaatcttggctcactgcaacctccgcctcctgggttcaagtgattctcctgtctcagcctcccaagtagctgagattacaggcacctgacaccacgcccggctaatttttgtatttttagtagagatggggtttcaccatgttggccaggctggtcttgaactcctgacctcaagtgatccacctgcctctgcttcccaaagtgctgggattacaggtgtgagccaccacacccggccaaatgtgaatactgaataaggacttcagacactgtcctctgggtattaccaacagggtttgacactagtaattgcagcgccacataagaaagaccagacgctggttagcaaaacaatggtaatcctctgcaatgcagcacatgtttgagaagcaattttatacagtagacagggtggaaaaaatggctctttggaagttttcttctaactcacagaatgcatcagcaaggaaagatagatcccggcaagctcaggggacatatgcctctctatagtgaaaaatattttctttctttttttttttttttttttttagatggagtctccctctgtcgcccaggctagagtgcagaggcgcaatcttggctcatgcaagctccgtcccgggttcacgccattctcctgcctcagcctcctgagcaactgggattacaggcctccgccaccacgcccagctaactttttgtatttttagtagagatgaggtttcactgtgttagccatgatggtcttgatctcctgaccttgtgatccgcccgcctaagcctcccaaagtgctgggattacagacgtgagccactgcgcccggctgaaaaatattttcatatccagatcaacattcatttcttaaaacatcttaacacatgtcctctgcctcctgtgtccacagactccagaaccctagcattccagaatcccccctccctactgtggctgctcccctcttggcaggcaccccaagttctggactagtatttcccctacagaagagaacaatatcagccaatctcagacttccctatgcagatgcaacatattatgtttcctatttcattcctagtcagtcattttgattgcaaacctccttctatttcaattttattactgtgggtttctttttgttgttattgtttgttttttttgagacagagtcttcctctgtcacctaggctggagtaaagtggcacaatctcagctcactgcagcctccacctcccgagttcaagtgattctcctgcctcagcctctcaaatagctgggattacaggtgcgtgccaccacacccagcttatatatatatatatatatatattttttttttttttttttttttgagacagagtcttgctctgtcacccaggctggagtgcagtggcgcgatctcggctcactgcaacctctgccttccaagttcaactgattctcctgcctcagcctcctgagtagctgggattacaggcatgcaccatcacgcccggctaatttttgtatttttagtagagacggggtttcaccatgttggccaggctggtctcaaactcctgaccttgtgatccgcccacctcggactcccaaagtgctgggattacaggcgtgagccaccgcgcctggcctatatagatatattttttgcattttttgtagagatggggtttcatcatgttggccaggctggtctcaaactcttgacctcagatgatccacctgcctcagcctgctgggattacaggcgtgagccatgcaccaggctagtgtagttttatttacaagaggcataacaatccatgaaccaagattgaaatattgtttcagttgaaaatagtttctaaaactacttgtgatattttctatgttacattttgagaagaatctatacttgccttaattcctaaaactaaatagaaaacatttcaaaatatactcatatgttactgaaatttaaagtcttttttttttttgagacagagtttcgctcttgttgcccaggctggagtgcagtggcatgatctcggctcaccacaacctctgcctcccaggttcaagcgattctcctgccttagcctcccgagtagttgggattacaagcatgtgccactacgctcaactaaatttttgttttgttttgttttgttttagtagagatggggtttctacatgttggtcaggctggtctcaaactcccaacctcaggtgatccacccacctcggtctcccaaagtgctgggattacaggcatcagccaccatgcctggactgaaatttaaagtcttaatttagatgttcaacatcttacaacaaagatacaatctataaaatctgatgttcttttttttttttgagacagagtctcactctgttgcccaggctggagtgcagtggcaccatctcggctcactgcaacctctgcctcctgggttcaagtgattctcctgcctcagcctcccaagtagctgtgactacaagcaggtgccaccacgcccagccaatttttgtatttttagtagagatggtgttttgccgtgttgggcaggctgttctcaaactcctgacctcaagtaatctgcctgctttggcctcctgaattgctgggattactggtgtgcgccaccacgcccagcactggattttcttaaatttctcttctttcatttttttttctctactgagcacttcagcttttaataaaattttcttcttttatctatgaatactcgtaaactttttttgggggggacttatccaaatgagcttctcagagtgttgcaagctaaacatctcctctcattctgcatagaaacagtggagttctggaagtaagtgtaactatttacctttcaagtcaataaacccaagggtgcacttcggtttattgttcgaacaatttgaacatttattaagtgccaacccttgtaaagaattacccagcaaccagaattcaacttggtcagcaggcaaggagtctcgatcagacaaactcgccattttgaaatatgaaaaattatgccgggcacggtggctcacgcctgtaatcccagcactctgggaagccgaggcgggcagatcacaaggtcaggagatcaagatcatcctggctaacacggtgaaaccccatctctactaaaaatacaaaaaattagccgggcgtggcggcgggcacctgtagtcccagctactagggaggctgaggcaggagaacggtgtgaacctgggaggcggaggttgtagtgagccgagattgcgccactgcactccagcctgggcaacagagcgagactccgtctcaaaaaaaaaaaaaagaaaaattacatggaagatggctggagaagacaagggtcgcatgcttctgtgtgccactgccacagaaacatcccgggtggtcagcccctcagtgaatgaatggagctgttttgaaaccagtgggatgatgacaactgtggaaagaccccactcggatctcctgctgcaggtgtaattgactgagaacctcaactgctgtcctctgaatctaccaccaccacatttacaataagaccgtgcttcctgagggctacgcccagacagcgactatgggataataaggtcacttcctgccagattctaatggggacttgggtcagtttggccaaaatcatctgagagctgcactgcagtctgggaccctcctacttactctgttctcttttctttctggggggtcaaatttccccattccggccaggcgaggtggctcacacctgtaatcccagcactttgggaggctaaggagggcggatcacctgaggtcaggaggttgagatcagcctggccaacatggtgaaaccccatctctactaaaaatacaaaagttagccaggcatggcagcacacacctgtaatcccagctactcagaaggctgagacaggagaatcgcttgaagccaggaggcagaggttgcagtgagctgagatctcaccactgcactccaacctgggtgacagagcaagactctgtctcaaataaataaataaatataaaaataaataaaattcctcattcctccaactttctccacttttttcccctcatcagtgtttcttccataaatctcttgtatgacaatcgtcttggcatctatttttcaaaggacctgaaccaacacaaggtggtaaaatactaacataaagttactgatttagccgggtgtggtggtgcatgcccgtggtcccagctactcaggaggctgaggtgggaggatcgcttgagcccaggaggtggaggttgcagtgatccaagatagcaccactgtgctccagcctgggcgacagattgagacctcgtctcaggaaaaaaaaaaagttaaaattaaaaatataaaaaaagatgactgatatagtttggatatttgtccctgcccaaatctcatgttgaaatgtaacccctagggttggaggtggggcctggtggaaggtgtttgggtctaggggtggatccctcatggcttggatagccagtgagttctcacaagatcaggttgttgtaaactgtgtgacacctcccccatccctgctatagcttctccttccaccatgagtaaaagctccctgaggcctccccagaagccaggcagatactggtgtcacgcttcctgtacagcctgcagaactctaagtcaattaaacctcttttctttttttttttaagacagagtctcactctgtcacccaggctggagtgcagtggtgcaacctcagctcattgcagcctccgcctcccgggttaaagcgattctcctgggattacaggcgcccgccaccatgactgtattttttttttttttgaaacagagtctcctcctgttgcccaggctggattgcattggcatgatctcagctcactgcaacctctgcctcccaggttcaagcgattctcctgcctcagcctcccgagtagctggaaccacaggcgtgcagcaccccgcccagctaatttttgtatttttagtagagacggggtttcaccatgttggccaggctggtctcaaactcctgaccttagatgatcttcccacctcagcttcccaaagtgctggagattacaggcgttagccactgtgcccggcctaaacttcttttctttataaaatacccagtctcaggtatttctttatagcaaggcaaagaaaggcctaatgcgatttctctctaagaggttgccttttcctagtacttgatttgccctaccaggtcagcaactctcctcaaatgtcagtcaaggagagacaacttcaatttatagccaactaccacaccaatctctttcatcctaagaacaattccctatgccactccttaatggtacacgaagggccatgtctcaactacaccttccccatcttaacaagaacacgaacacacacacacacaccacacactctcaagtgccattattcattttgaaccaagtaagcttatcctttgaaggcactctccatttctccccttaatgaggcataattactacattaataataacacaaataaaatgcttcccataagaatagcatttccaggcgggggcggtggctcacacctgtaatcccaatactttgggaggccgaggcgggtggatcatctgaggtcaggagttcaggaccagcctggccaacatggtgaaaccccatctctactataaatataaaaattagccaggcgtggtggacacctgtaatcccagctgcttgggaggctggggcaggggaatcgcttgaacctgggaggtggagattgcagtgagccgagatcgcaccactgtactccagcctgggcagcaagagcgagactctgtctcaaaaaaaaaaaaaaaaaaaaaaagaatagcatttccaagccttatacataaacagtacctcatttgatcctcatcataacatcaagggtagacatgaccagtattattagcctcacttcacaaaggaagaaactgagactcagactgttgtctctgggtatcagtttccaagtctgtccaatgaaggattgagccctgtgacctctaagaactcttccacttctaaaattgtataatttccataatttgtctgacatcactaagacagtagttagtggcagattagggacctgagagaatgacttggtgccaggctgattctcccacaacgtgttatctttgctgccaatagcaatggctaacatcagctatgcgatatgtcctgcactgtgccagttactcacgaggcattgttatttatttatttatttatttatgtatttatttatttatttattgagatggagtttcactcttgttgcccaggctggagtgcagtggcgcaatctcggctcactgcaacctccgcctcccaggttcaagtgattctcctgtctcagcctcccaaatagctgggattacaggcgtccatcatgcctggctaattttgtatttttagtagagacagggtttcaccacgttggtcaggctggtctccaactcctgacctcaggtgatctgcacgcctcagcctcccaaagtgctgggattagaggcgtgagccaccgcgccagtccagagcattgttgaatacctactcagcattgtcctccatcccgctgcgtaaatgtattgagatttcagttacatacacacttaatggagaaggcgacaccacccctgctccaaggatgtactctgatcgacactttccattcttctggccatagtcattgggtgacttgggggctctgaactggaatgccggaacagaagtacactctctcctgctgaacatacattaggaagcactggcttctgctgctactggcagcctctctgtggccctaaggggaagcctcaggattcttgtttggaactgatagtttttagcagctaaaatctgagacgtctataccgtatccttaaaactctgaataaacaacataggcaaagacagatgatgtcactgagacccagagaggatattagaccttgcccagcatacattacctattgggggccagttaggactaaattacaagtctccagcaactgacctagggttctcttggcctcagcatgtggaaggggccccacgtgcaaaggttccggataaagatcagactgtgatctagctgatgaacagaacccagaagtatgtttgagggggaggaaggaggaggctaagagaggccttcttatgttctgcttttttgccctgaggggatgacacttaaccactgcagaggctgcagctgagccgcagggatggtcacactgaaccagtagttcttcccttcccccactctaaacctctgccaagcagagagcctctgagactgctctggagaaaggggctgcctgccaactatctgcccacctggggccagggtgagggcaaggccagtggctacattctgtgaacagctggaaaaaaagtaggcaacacagtggccttgggacaatggccttcccactctccttgtcacgaaatagcaggattaaaaaaaaagggggggaggatatttatttaatccttttgttacaaattaaagttgctaatttgttttcaaaaattgcaggaaataaagtacacgaatcaaagaaacacaaaatatttaaaaacaaaatagctattctcccaactttcttacttataggtatgtctatacaattgtggcagaatccaaagggaaggacagtttggttagtccatttggtcacagcaaatgtacctgttcatttgttcatcaacgatttgttgagcactcaccttgtgccctgaagatacagttcagaaaaaacaccgaaaaggcccctgtgtccagcagctcacatcttaatggtggaagggagatgaaggagaacagaccataataagtaagtaaacaatgatttcagactgtgccaagagctctgaggaaaacacggtgatatgatagggagcggggaaaggtactttaggtacaatgtcagaaatgcctcccccaggccaggcgagggggtgcaagcctggaatcctagcactttgggaggccgaggtgggtggatcacttgagcccaggagtttgagaccagcctggggtttcaccatgtgaaacccagactccacaaaaaaaaaaaaaaagacaaaaaaaattggctgggtgccatggctcatgcctgtaatcccagcactttgggaggccaaagcaggtagagctcaggagttcaagaccagactggccaacatggtgaaaccccgtctctactaaaaatacaaaaattaactgggcaccatggtgggtgtttgtaatcccagctacttgggaggctgaaacaggagaatcacttgaacccaggaggtggaggttgcagtgagccgagatcatgccactgcaccccagcctgggtgaaagagcaagactctgtctcaaaataaataaattaattaaattaaattaaaattaaaaaaattagccaggtgtggtggtgcatacctgtagtccccactacttgggaggctgaggtgggaggatcacttgagcccaggaggtcaaagctgtagtgagccgagattgcaccactgcactccagccttggagccttggcaacagagagagaccctgtctcaaaaaaaaaaaaaaaaaaaaaaaaaaaaaagaaagaaagagaaagaaagagaaagaaagaaaaaagaaaaagaggccaggtgcagtggctcatgcctgtaatcccaacactttgggaggctgaggtgggcagatcacttgaggtcaggagttcgagaccagcctgaccaacatggcgaaaccctgtctctactaaaaatacaaaaattagctgggtgtggtggcaggcacctgtaatcccagctactagggaggctgaggcaggagaatcacttgaacctgggaggcagaggttgcagtgagccaagcatgggcgacagagtgagactccatctcaaaaaaaggaaaaggaaaggaaaggaggaagaaacgaagaaacgaaggaagaaaggaagaaagaaagaaaaataaagaaaagagagagaagagggaaggggaggggaggggagcagggaagagaggagaggctgggcccagtggttcacacctgtaagctgaggtgaaggagtttgagaccagcctggccaacatcgtgaaaccccatctctactaaaaatacaaaaattagccagggttggtggcacgtgcctgtaatcacagctactcaggaggctgaggcaggagaatcgcttaaacctggaaggcggaggttgcagtgagctgaaatcgcaccattgcactccagcctgggcgacagggcaagactccgtttcaaaaaaaaaaaaaggagaaagaaacaaagaaagaaagaaaaatgcctccccaaggtgacagacgagctaagccaggcgaaaagtctaaagaaattcaagtgcaaaggccctctggcaaaaaggtcttggcagaaaggtggtcagtgtgcctgctgcactgaaactgctcctgtaaggcagggatcctataaggtaggccttgaatgtcatgatggggagctcggttaggacccccatgataggtaggaaggcagctggaaagagcagttctgccatttttacggatacattcatgagccatgatgggtcgtcctggtggacctctggagcctgacctgggtccacgtttgaggtctccgactttagtgaccctgggaaagttacttgagtttcctcatttgaatagccaagggtttctcgtgtttgatgccaaatgccttgtgcggggattggctccaaacctcagcctcatcagtcaatttatccttacgttcaagagcagccatttacaaaacgagctcagaaaattaaaaaaaaaatacaaactttaaatcgccagaatactgcataaactaaaagtaggccgggcgcagtggctcacgcctgtaatcccagcactttgggaggtcgaagcgggcggatcacctgaggtcaggaattcgagaccagcctgaccaacatggagaaaccccgtctctactaaaaatgcaaaaattagctgggcatggtggtgggcgcctgtactcccagctatttgggaggctgaggcaggagaattgcttgaacccaggagacggaggttgcagtgagctgagatcgcgccactgcactctagcctgggcgacagagcgagactccatctcaaagcaaacaaacaaataaaaacaaagtaaaagtaaattccccaggcaaagctgattatattgctgggataatcgactttgtcactgcagtctcacttggtactttaagaaactccatcttgatcctaggtctgggtcgatctgggcgttcctgctaattttctgttttaaaaacctaaagcaataaaaatgttgatattgacatttatcatttttatcctcgccctctgccttgttttgctgggagatctgttccacttggctgagtttagggagggcggggaagcgggggagaaaccgaggcgcagggtggagaaagggagaagccttgcagactgaacacatgagaaaacctggagaagggattcgctgctgcttatttcagggaagaaaaccgagaagtgaagcacagaggggtcaggttccgggagcggcgggaaggttgtagggggccccagggcaggtcctggagctcaggcagccggcaccgggagcccagctcaggctgcggggtgcaaccgggcaagagcgctcgggctgccgaaacgggaggagatcagaaaaaggagagacatggaaaaaaggagaggaagaggagcaacactcaagagggaaggaagaaggcagacactgaggaacgcccgcaggaacccgcagacaagcagagagccgggctgcgctgggagcggggcccgcggaaggggcggggcgccaggcggctcgaggccaatgggagggcgggccggggcgagggcggggcactaggcgaaacgacgccaatgggagggcgggccggggcgagggcggggaattaggcggtgcgaggccaatgggagggcgggccgggtcctctgggctgaggcggggtgccaggcggcacgaagccagtgggagggtgagttaggggcaggggcggggtcccaagccaatggaagggtgataccgagagggcggggcgccaggcggcgagagagccaatgggaggccgagccgaggaccgcgggcggtgggcctccccccgagaggagggagacccggaaggcggtgggggcggggagtggagctgacaacctgtcaaatccactttgggacgaactaggtcacgcgctccgcgggtcgggcacccccgcccgccaggcacggccgcggctccttcctcttcctgcccgcggtagtgggggtggggcaggcctcgggacacctgcctccgccgccggccgccggccgccgtcctcgcgcggcttcccgggcggctctgccccgaccgtagactcccggcccgctcgccgcggcaggagccgtggttccgcggacctgggcgcgctctctccctggccactgggagaccccccgcggcctcgcggggaaaacctcgggactgccccgcgcccccggccgtctctgcgtcgctccttctcgcccgcgaccgtggactcgtcctcgcgagcctgggttggcggaagctgcgggggccggggtcgcactacttggcgcggaagggccggcggtgggcggagggatccccgtccgcggggtgagccgctgggcggagccgggaggagccgcgaggatccgcagtggggagccgggaggaacctggcgccggcacccacccgccgcgcccacgcgtgccgcggtcgcttgtttcccgcgggagcccggccgcgctcggggggaggcgcgcgcgcagctggggctgcctgggtctaggagctccggagccaccgttttgtgcccgtggagccgcggggaaggcgcacgcgctcgggtcttcccggcgggtcgtcctgcactttctccctctccggtacggaccgcggcgttctgtttccaggcaaaggaaaataagtcaaagactcagaaggcagcctgaatccagggcctgggatgcagggtttgctggaacgccagccggtgcgatcgcgcccctgggattccgcttagcccgcgcgtccatttccctgcatggtggactcagtaaagccggatctgtccaacgcctgcagcgtggatgtggaggcggactaatcaactagtgctctgttattatttctacccatcccttttctccatgctaatttgcttagaactttaacattgaatggacagcaaatgtcatgttctgtttaattatcactccttgaccattatgttaatttctttccctaacaaggtgacgcattgttttaagtaacaatgaccaactcatctactcttcttccaaattgtgtaaattgaagggtaaaatgtgggaaaacgctaaatttgaatgctaaatttgaacatttcacacaacaataatttgaaatgcttctttgcaatattatggcgtttcggaacagataaaaatacttcattttcagacatttggtcaacaaatacttcttggacgtttatatgcaaagcaatgcatgtaacattttcattactttgcaagtgtgcttatcagtaaaagaattttgttttaaattctagccttcgtttaaatgtattttagttaccacattgggaagaaaataaaatattactatgtacggaatgtacagacgtatgtttttttatttacaaaaaatagaaagaaaatatggccgggtgctgtgggtcacgcatgtaatcccagcactttgggaggccgaggcaggcggatcacctgaggtcaggagttggaaactatcctgaccaatatggtgaaacccactctctactaaaagtacaaaaatgagcctgggcgtggtggcgggtgcctgcagtcccagctgcttgggaggctgagacgggaaaatttcttgaacccgggaggcggaggttgcagtgattgtgccactgcactccagcctgggcaacagagcgagactccgtctcaaaaaaaaaaaatctatatctatatatatatatagatatataaagatatagatatatagatatctatatctaggtctatataagtatatatctatagatatctatatataggtctatatagatatatgtatagatatatatagatacctatatatctagataaatgtatagatatatagatctatagagatatctatagatctatatagatgtatgtatagatatatagatctatggagatctctatagatctatatagatatatgtatagatatatagatatctatatatagatatataggtctatatatagatatctatatatagatatatatgttccttaaattcaacattaagaatgagcttattcataattagctgtagtattacacttgaactaccatatttattacatttataaatactatttataaatagtaatataaatagtaaatgctattaacatttagtaaatgctattaaggtaggaatagaggttccaatcttttaaatagaaattaaatacaaacaaagcaacaaaaagagacctttcatatatggttattggcttgtcattgtagccagttccttactgccagctaattttccaaagggaatcgttgctttctgttttgaccaattggcaacctcaacagtgctagaaactcttagccctcattgggtatataaatatatatcttatttcaaatgttttgttatctattcctactgaaggttgttttcttctctcttttttttttgagacggagtctcactctgtcaccagggctggagtgcagtggcgcgatctcggttcactgcaacctctgccaccggggttcaagcgattctcctgcctcagccttctgagtagctgggattacaggcgcccgccactatgcccagctaattttttgtatttttagtagagatggggtttcaccatgttggccaggcggactcaaactactgacctcgttattcacccggcgcggcctcccaaagtgctgggattatagtcatgagcccggccctctttttttttttcgttttttttttttttttgtgctcatcattttgatcttaatacccactaaaaagataataaaaccacaagtgtttttcttcagatcacgagattgtcaataatagaaagtcaacactgtcaaatcatgagaatgaattgcatatcattgtacaaaaattgaatactggaatttagctcctagatctattatattaccataataagaaaaactaaagaattaaaaaatctaaacaaaatgcaatcctaaatgatattgcggccaggcacagtggttcacacctgtaattcagcattttcggaggccagagcagatggtggcttgagcccaggagttggagactagcctagggaacatggcaaaacctcatctctacagaaaggaaaaaaggcaaaacctcatctatacaaaaaattagctgggcgtagtggcacatagctgtagacctagctactcaagaggcagaggcaggaggattgcgtgagaacgggatgtcgagactgcagtgagccataatggcgccactgcaccccagcctgggcaacagagcaagaccctgtctcgagacaagttcgtcttgctgcatttcagtatttttaactcctttaatgtagtgtagacaattttgatatgatgtgtcacatctttttttaacgtctaatttctttttttttttttttgaaacggagtttcactcttgttgcccaggctggagtgcagtggcgtgatctctgctcactgcaacctctgcctcccgggttcaagcagttctcctgtttcagcctcccaggtagctggggctacaggtgcctgccaccatgcccagctaatttttgtgtttttggtagagacggggtttcaccttgttggtcaggctggtctcgaactcctgacctcaggtgatccacccacctcggcctcccaaagtgttgggattataggtgtgaggaacctggccttaacgtctaatttcagaagaaagctaattctccttttttttgggggggggggacagagtctcgctctgtcacccaggctggagtgcagtggcgcgatctcggctcactgcaagctccgcctcccgggttcactccattctcctgcctcagcctctccgagtagctgggactacaggcgcccaccaccacgcccggctaatctttttgtatttttagtagagacggggtttcaccgtggtctcgatctcctgacctcatgatccgcccgcctcggcatcccaaagtgctgggattacaagcatgagccaccgcgcccagccgaagaaatctacttctttccgttcctcttaaagatgaaaattagaaacattctgccttaattatttttatttttttgagacagtcttgctctgtcgccaggctggagtgcagtggcatgatctcagctcacggcaacctccgcctcctggattcaagcagttctcctgcctcagcctcccaagtagctgagactacaggctcgcgccaccacacccatctaatttttgtatttttagtagagacagggtttcaccatgttggccaggatggtcttgatctcttgacctcgtgatccacccgcctcggcctcccaaagtgctgggattacaggcgtgagccaccgcgcccagcctttgccttaattatttcttctgttatatcccctgctagcaaacttttggaataggtttgggaaattaattacctttataaatggagttactattttgcccaaacatttcatgtataattctgtaaggatgatttttataatttcctacccaaatgtcttggcacagttttatttctcaattggtagtgaatttcctagactaggaggaaaaagcagtaagtcttcttactgcttctggggagaagggtgggtggctttaccttggtaaggacattctcagggcagctcagaatgctgaggttgaggactctgtggttggaaattcagctcaaacccaaaggggtggaatattttgtgaatgggaaacaaatacaccttgagttggaagttacaaatcagtggtcacagatatgtattgtttgtctctacaatgtctagaaattttaacattagtttccaagatttaaaaaataagagatttcagggccgggcatggtggctcacacctgtaatcccagcactttgggaggccaaggcgggtggatcacttcaggtcaggagttcgagaccagcctggccaacgtggtgaaaccccatctctactaaaaatacaaaaaattagctgggtgtggttgcaggcgcctgtaatcccagctacttgagaggctgaggcaggagaattacttgaacccgggtggtggaggttgcggtggagctgtatcttaccactgcattccagcctgggcgacagagcaagactccatctcaaaataaataaataaataaataaaataaaataaaaaataagagatttcagataagaatacagaattgtaacttcttttggaaatcagtcagatttggccatttcttgcacgattacctgcggtattgctgactagctgctgccctctttacacagggtgtacactccatatatcaggctcagtacagtcatttatcttcaccacctggccactgcagggatctgtgtttggaatactgatatggtttggctctgtccccaccctcctaaatctcaacttgaattgtaactcccagaattcccatgtgttgtgggaaggacccagagggaggtaattgaatcatgggggccagtctttcccgtgctactcttgtggtagtgaatacatctcatgagatctgatgggtttatcaggggtttctgcttttgcttcgtcctcattttttcttgctgccgccatgtgccttttgcctcccgccgtgattctgaggcttccccagccatgtggaactgtaagtccaattaaacctctttctgttcctagtttctggtatgtctttatcagcagtgtgaaaacaaactaataaatcccagcactctgggaggccgaggtgggtggatcacctgaggtctggaattcgagaccagcctgaccaacatggagaaaccccgtccctactaaaaaaaatacaaaattagctgggtgtggtggcacaagcctgtaatcccagctactcaggaggctgaggcaggagaatggcttgaacctgggaggtggagtttgcattgagccgagatcgtgccattgcactccaccctggggcaacaagagcgaaactccatctcaaaaaaaaaaaaaaaaaagaaaaaaaagaaaagaaagaaagaaaacaaactgataaagtaaatcggtaccagtagagtggggcgttgctgaaaagatacccaaaaatgtggaagggactttggaattgggtaacaggcagaggttggaaccgtttggagggctcagaagaaaacaggaaaatgtgggaaagtttggaacctcctagagacttgatgaatggctttaaaaaaatgctgatagtgatatgaacaataaggtccaggctgaagtggtcccatagggagataaggagcttgttggaaactggagcaaaggtgattcttgttatgttttagcaaggagactaacagcattttgctctgtgctagagatgtgtggaattttgaacttgagagagatgatttagggtatccggcagaagaattttctaagcagcaaaacattcaaaaggtgacttgagtgctgttaaaagcattcagtttttaaagggaaacagaggccaggcacagtggctcatggttgtaatcctaacactttgggaggtcgaggtggacatatcacctgaggtcaggagtttgggaccagcctggccaacatagtgaaatcgtgtctctactaaaaaatgcaaaaattcgctgggtgtggcagcgtgcaactgtaatcccagctactcagcaggctgaggcaagagaattgcttgaactggggaggcagagattgcagtgagctgagattgcaacattgcactccagcctgggcaacaagagtgaaactccgtctcaaaaaacaaaaaacaaaaaacaggaaaacagaacataaaagctcagaaaatttgcagcctctgatgcagtagaaaagaaaaacccattttttgaggagaaattcaagctggctgtagaaatttgcataagtcgcaaggagcctaatgataatccccaacactatggggaaaatgtctccagtccatgtcagagaccttcacagcagcccctcccatcacaggcccagaggcccaggaggaaaaagtggtataatgggccaggcccagggtccccatgctgtgtgcagcctagggacttgttgccccatgtcccagccgctccagccgtggctgaaagggaccactgtagagctcgggctgtggcttcagagggtggaagccccaagccttggcagcttccatgtgatgttgagcctgcacatgcacagaagtcaaaaattgaggtttgggaacctctgcctagatatcagaagatgtatggaaatgcctagatgcccaggcaaaagtttgctgcaggggcggagccctcacagagaacctctgttagggcagtgcagaagggaaacatggggtcgaagcccccagacagagtctctactagggcactgcctagtggagctgtgagaggagggccaccatcctctagaccgcagaatggtagatccacggacagcttgcaccatgtgcctaggaaagccacagacactcaacacaaacttatgaaagcagccaggagggaggctatagcctgcaaagccacagtgacagagctgcccaagaccatgggcacccacttcttgcatcagcatgacctggatgtgagacctggaatcaaaggagatcattttgaagctctaaaattcgactgtccttggggccgggtgtggtggctcatgcctgtaatcccagcactttgggaggccgagtcaggtggatcacaaggtcaggagttttagaccagcctggccaacatggtgaaaccccatctctactaaaaatagctacaaaaattagccaggcatggtggcatggccctgtaattccaggtacttgggaggctgaggcaggggaattgcttgaacatgggaggcagaggttgcagtgagccgagattgcgccactgcactccagcctgggcaacagagcaagactctaaaataaataaaataaaataaaataaaacaaaataaaataaaataaaatttgactgccctactggatttcagacttgcatgggccctgtaacccctttgtttggccaatttctcccatttggaatagctgtctttacccagtacctgtacccccattgtatctaggaagtaactagcttgcttctgattttacaggctcataggcagaacggacttaccttgtctcagatgagactttggactgtggatttttgggactttggggaactgttgtgaaggcatgattggtttcgaaatgtgaggacaagagatttggaggtgtcaggggcagaatgatgtggtttggctgtgtccccacccaaatctcaacttgaattatatctcccagaattcccacatgttgtgggaggaatccagagggaggaaatagaatcatggaggccagtctttcctgtgttattcttgtggtagtgaataagtctcacgagatctaatgggcttatcaggagtttccacatttgcctcctcctcatttttctcttgttgccactatgtaagaagtgcctttctcctcccgccttgattctgaggcctccccagccatatggaactgtaagtccaattaaacctcttttttggctgggtgcggtggctcacatctgtaatcccagcactttgggaggccaaggcaggtggatcacgaggtcaggagatcgagaccatcctggctaacatggtgaaacaccatctctactaaaaatacaaaacaattagctgggcgtggtggcgggcacctgtagtcccagctactcggtaggctaaggcaggagaattgcctgaacccaggaggcggagctctcagtgagccgagatcatgccactgcactccagcctgggcaacagagcgagactctgtctcaaaaaaacaaaaacaaaactttttgttcccagttttgagtatgtctttaccagcagtgtgtaaatgaactataatacaaatactctaggtcatataaattgttttttctttttgagacagggtcttgttctgtcacccaaactggagtgcggtggcatgatctcaactcactatagcttccacctcctgggctcaagcagtcctcccaactcagcctcctgaatggctgggaccacaggcccacatcacaatgcctgggtaatttttgtacttttagtagagatggggtttcaacatgttgctcaggctggtctcaaactcctgggctccaagcaatctatccaccttggcctcccaaagtgctaggattccaggtgtgagccactgtgatcttaggattttgttcaaggtaaatacagtgaactagtaaatagaaagttattaagatcatatatggcaactggatgcatcccattattttgtttaccagtccccaggcacagggaatggtcaggcaatatttaggtgaaaatgttaataaaaaatggaaataatggctgagcacggtggctcacacctgtaatctcagcactttgggaggctgaagcgggcggatcatttgaggtcaggagttcgagaccagcttgaccaacatggtgaaaccttgtctccactaaaaatacaaaaaagttatctggctgtggtgatgcgcacctgtaatcccagcttcttgagaggctgaggcaggagaatcccttgaccctgagaggcagaggttgcagtgagccaagatcacgccagtgcactccagcctaggagacagagccagacactgtctcaaaaaaaaaaaaaaaaaaaaaaaaaaagaaagaaaagaaaaaaaaagaaaataatgtttttgtgctttcctttccatgtagaaagtccttcccctgggccgtgcatgatggtgtgcacctgtagtcctaggtactctggaggctgagatggaaggatcgtttgagtctaggagttcaaggctgtagtgcattatgatcacacctatgaagtagccactgcactccagcctgggtaatgtagcaagacctcatctctaaataattataatagtgaataataataatgacgacagtccttgccttgattcaaatgaacatcactggaaatcttgactaattagaacctagcaatagtagtcaactgtgaaagattatactagaagaagaaattccccaaagtactacagaactaataacgatgatgacaataacaatgtcttgacattgagcagagtgctggacattgttctaaataatttatatacactatgtcgtcatattttagtttcctcattgtgcacatgtaccctaaaacttaaagtataataataaaaaaaagaaacacacacaaataaataaatgaactctacacagcaaaaaaaaaaaaattaaatattttagtttcctatttgctacctcatcttcctttacttttttttccttttctttcttcttctttttttttttttttttttgagacggagtctgactctgttgcccaggatggagtgcagtggcgcaatctcagctcactgcaacctctgcctcctggggtcaagtgattcttctgcctcatcctccctaggagctgggaatataggcacgtgccactgggcccagctaatgtttgtattttagtagagatggggtttcaccatgttggcctggctggtcttgaactcctgggctcaggtgatccacctgccttggcctcccaaagtgctgggattacaggcttgagccactgtgcctggcctggttttgttgggttttgatgaggaagtagatggaggaggggaggtggtagctgtgtctaggtctgtctccatctattggcccttagtgctctcgtatttctctctcttttgagtttctcattttgctcctaccacatttgctgcctcagtcttggctcattctctctctcctctgcccttgtcagggaatatttcttactgacatgagaagtcagatgccagtagaaaaagacacaccaaccatgacagaaaagacctgaaagaggatatgcttggggtacaattagagaaaggcaggaaagaacaaacattcagtcactttttaggaccagtaagggccaaaggttagcataatcccgaaggtacagcaaactacagcattcatcttgtgcctgggttggagggttcaaggcagctgaagaaatggaagatgaggccgggtgctatggctcacgcctgtaatgccaacactttgggagcccgaggcaactggttcacctgaggtcacgggttcgagacaagcgtggccaacatggcgaaaccccgtctctactaaaaatacaaaaatcagccgggtgtcgtggtggacacctgtaatcccagctactcaggaggctgaggcaggaggagtgcttgtacccaggaggcggaggttgcagtgagggagatcacgccactgcactctagactgtgccacagggcgagactccatctctaaaacaaataaacaaacaacaaaaaaaccaaaaaaccaacgaagcccaatgagaacagcagcatgctggaaaagattccaggtttgttcagatgggttgtgtattatgatgattgtgagtagtctgaagaaatagaacaattctgtgaagttacatttagttgggatctacatgcattgatagagaaatgtttaaataaaatgtatatcttcggccgggcgcggtggctcacgcctgtaatcccagcactttgggaggccaaggagggtggatcacgaggtcagaagttcgagaccagcctagccaacatggtgaaaccctgtctccactaaaaatacaaaaagttagctgggcatgttggcaggcgtatgtaatcccagctactcgggaggttgaggcaggagaatcgcttgaacctgggaggtgaaggctgcagtgagctgagaccgtgccactacaatccagcctgggcaacagagcgggcctccgtcttaaaaaaaaaaaaaaaaaaagtgtatcttcatataacggaatgcttatgagaagggtttaataaaatggcctaataccatatgttagatgaacagagaaccatgaaataaaattatgtataaaaacacatttaggagttaaaaggtggtgttagtttttttgtttttttttctgagactgagtttcactcttgttgcccaggctggagtgcaatggcgtgatgttggctcattgcaacctccacctcccgggttcaagtgagtctcctatctcagcctcctgagtaactgggattacaggcgtgtgccaccatgcccagctaatttttgtatttttggtagagatggggtttcaccatgttggccaggctggtcccaaactcctgacctcaggtgatctgcctgcctcggcctcccaaagtgctgggattacaggcgtgagccaccgtgcccagctggtgttagttttttaattgattaaaatacatttaaaaggatagaataaaagggcagatgaaaatatggcaaaatcatagcagttatggatttccaaaaatttttctagtgacatgttgtacatacacaatcagggaagaaactaaaaatcaaactgagcatgtgcttattgagttttagttccataaaagaaacaaaaaaattatactacagctacagatgttactgtctccagatttcaaaaatgttttccaactatctcaagggaactgggcaagagagaacagatggctgagcataacctactcccaatgctagagaagtaaatcaaagtgcatttcatactgatgctacctcagtaataccggctttgagcagagagggatggtgtgaattattttcccccactgtaacccttaaagcccgcccgtcccccagctttgtttgaggaaggatagtctatgacggatggatagcatctaagaagggatgttagtttgctagggctgcggtaacaaagtagcacagactgggtggtagcagaaatgtactttctcttagctccagaggcctgaagtccaatatcaaggcattagcagggttggcctctcctgagggcgtctcagcttgtagatggtgtctttttttgtgtcttcacatggttttccttatgtgtgtgtctgtgtcctaatctcctcttgttataaggacaccagtcatattgaatcagggcccacactgataacttttttttttcagacagggtctggctctatcacccaggctggagtgcagtggctccatcatggctcactgcagcctcaacctcttgagctcaagcaatcctcctgcttcattcagcctctcaaatagctgggactacagaagtgtgccacaatgcctggctaattaaaaaaaaattttttttttggccaggggcggtggctcatgcctgtaatccagcactttgggagactgaggcaggcggatcacctgaggttaggagttctagaccagcctgatcaacatggagaaaccccgtctctactaaaaataaatacacaaaattagccgggtgtggtggcacatgcctgtaatcccagctactcgggagggtgaggcaggagaatctcttgaacctgggaggtggaggttgtggtgagccgacattgcaccattgcactccagcctgggcaacaagagcgaaactccatctcaaaaaaaaaaaatttttttttttttggccaggcatggtgactcacacctataatcccagcactttgggagtccgaagcaggcggatcacccaagatcaggagttcgagaccagcttggccaacatggcaaaacgccttctctactaaaaatacaaaaattagccaggcatgatggtgggcgcttgtcaacccagctactcaggagaatcccttgaccctggaaggcagagctgagatcgtgccactgcactgcagcctgggcgacagagcaagactccatctcaaaaaaataaaaaaaaaaaaaaagaaaaagacaagtataacaaccaaacaaattccaaactgcattgactttttctacagcaaggaaattttgatttgaaccaaagaatccttcatttcattttgtagcaggctccagtcccttttgggaaaggtaagggtatatataatgaataaataaataatatcactgtattttgcattggcagaaaaaaaatctgtatgtgcaagcaacaatcttttccttgtttcaatattaaattgcttacttggactaaagtaaacctttagaagtataaaactgcttggtattcgtatcagttagcataaattcaaaggaaatcaatcagcataaccaaatgacattgagtcaatgttgacttactcttctactggacttctttttttttttgagacagggtcttgctctgtcacccaggctggagtgtaggaatgatccccacttactgcaacctccaccccccagctcaagtgatctcccacctcaacctcccaagtaactgggaccaccccgccatcatacccagctaattttttttttttttgagacagagtcttgctttgtcccccaggctggagtgcagtggcccaatcttggatcactgcaacctctgcctcccgggttcaagcgattcttctgtctcagcctcccgagtagctgggattacaggcacaggctgccacgcctggctaatttttcttttttttcaggggaggtggggggacagggtttcactgttgttgcccaggcaggaatgcaatggcgtgatctcggctcaccacaatctccgccttccaggttcaagcaattctcctgcctcagcctcctgagtagcgtggattataggcatgcaccaccacgcccagctaattttgtatttttagtagagacaggggtttctccatgttggcaggctggtcttgaactcccaaccttaggtgatccgtctgccttggcttcccaaagtgctgggattacaggtgtgagccactgcgcccggccacctggctaattttttgtattttagtagaaacggggtttcaccatgttgccaggctggtcttgaactcctgagctcaggcaatccactcacctaggcctcccaaagtgctaggattacaggcgcaagccaccacacccggccctttttttgtatttttagtagagatgtagtctcatcatgttgcccaggctggtttgaactcaagtgatccaccctgtcctcccaaagtactaggattacaggtgtgagtcaccactcccggccaagacttctttttatttacatttcatgggaattatattttggagatgcctaaggcacagaaaacttaaatgatgctatagactgaattgttttcccccacccattcatgcgtttaacccctaacccccaatatcactgtatctggagacaggatctttaggaggtaattaaggttaagagaggtgcactgatcccagcccctctctctgccacatgaggacacttagagaaggtggcagccacaaagcaggaagaccgctcttgccagaagcagcagctgcaggcacactgatcttgggcttcctagtctccagaactgtgaaaataaatttatgtttatttatttacagacaaggtctcactctgttgcccaggctggattgcagtgtcatgatcatggctcactgcagcctcaaattcctagactcaggtgattctcccaccttggcctcccaaagtgctgggattacaggcatgagctaccatgcccagccaattctgttgtttaagccacccagtctgtgtgttttgttatagcagccggcagactcatacaaatgacctgcctaaacccttgactgtctcctttgtagctttcaggtcttcatcttacatatgtcttcattatttccttttctgaagaaatgacacccagtccaccctagcaaaagtaagccccatgctcattctctgtcagagcacttttttgtttctttttttttgagatggagttttgttcttgttgcccaggctggagtgcagtggtgtgatctcagctccctacaacctccgcctcccaggttcaagtgattctcctgcctcaacctcccgagtagctgggattacaggcgcccaccaccatgcccggctaatttttatagttttagtagagacagtgtttcaccgtgttggccacgctggtcttgaactcctgacctcaggtgatccacccgcctcagcctcccaaagtgctgggattataggtgtgagccaccaggcccagccatcagagcactttttagaaagcatttatcctggccgggtgcggtggctcacacctgtaatcacagcattttgggaggccgaggcaggtggatcacggggtcaggagtttgagaccagcctggctaagatggtgaaatcccatctctactaaaaaatacaaaaattagccaggcgtggtggtgggcacctgtaatcccagctacttgggaggctgaggcaggagaattgcttaaacccgggaggcagaggttgcagtgagctgagatcgcaccactgcactctagcctgggtgacagagagagactctgtctcaaataacataacataacataacataacataacataacataacataacataacataacataacataacattacataacataacataaaatgcatttatcctagtcggtattgatttgtttacttgttgattttcacttgcatatcacggagaccctctctctcttgctctgtcaagtgccttctcaaggcggaaggcctcacacatggcaggcagtacaaggaaatcctctgtctatcaacaactgtgccctatcgggctgagcaaataggcctgaggactttagttttccagtcacaatgaagaacatgtaataagtggggccagtggaagctgtttccaacctaggctaggcaattaacccactgactcaatgtgatgatgctgtcttgatttgattctctacttcattcaaaacaggctcagactgaatagaaaagagaatctgttcaaagtttggttacagattccacttgttaattgatgatgatggtgaacgagcagagtgtatgacattttgctaagtgttcattgtgaaaagagttcagagcttggatccaggaacttgccccaccaatggggttttgctgtaggcagctgtacggccttgggcgaggcatttacccctttctctctctgtgttctttctttctttctctcccttctttctcctttcttttctcttctcttctccttccttcctttctctctctcccttcctcccttccttccttccttccctcccttccctcccttccttcccttccttcccttcctttccttccttttcttttttgagacaaggtctggctctatcacccaggctggagtgcagtggcatgatctctgctcactgcaaccgccacctcccaggttcaagcagttctcatgcctcagctgcctgagaagctggaactacaagtatgtaccaccatgcccggctaaattttttttttttagaaatgcgtttttgccatgttgcccagcctggtctcaatctcttacaatctcaagttgccagaaggtgctcctttgcctcttaggagggtgacaaggtggtagataaacttctccatggccaaagatggcatgctccctgtagaacctgctcccttcagaaactcccccaccagggctgggcgcagtgacatacctgtaatcccagcacttcgagaggctgatgtgagaggattacttgaagtcaggagttcgagaccagcttgcgcaaggtagtaagactaccccaacttctctgtaaaacattgaaaaaattgaaataacaaaaaagaaagaaacttccctaccagaatatgaattaaggtgtttccccatgaagaaatcacatcgtaaaatagcatgattaatacaatcacattctaacaatagcatgagtatgaggtcaagcctggtcacaccctccaactctgtaaaagaaaacttagctgggggctgggcatggtggcccacgcctgtaatcccagcgctttgggaggccgaggcaggtggatcacttgaggttaggagttcgagaccagcctggccaacatggtgaaaccctgtctctactaaaaatacaaaaagtagccaggtatggtggcgcatgcctgtagtcccagctgctcgggaggctgaggcagaagaatcgcttgaactcggaaggcaggggttgcagtgggctgagatcttgccactgcactccatcctgggagacaagagagagactctccatctcaaaaaaaaaaaaaaaaaaaagtcaggcacagtggctcatgcctgtaatcccagcactttgggaggccgaggtgggtggatcacgaggtcaggagttcaagaccagcctgaccagcatggtgaaaccccgtctctacaaaaattagccgggcgtggtggtagtcacttgtaatctcagctactcgggaggctgaggcaggggaatcgcatgaacctgggaggcagaggttgcggtgagctgagaccacaccactgcactccagcccgggcgtcagagcgagactctgtctaaaaaaaaaaaaaaagaccaggcatggtggctcatgcttgtaatcctagcactttgggaggccaaggcggggggatcacgagatcaggagatcgagactatcctggctaacatggtgaaaccctgtctctactaaaaatacaaaaataattagccaggcatggtggcgggtgcctgtagtcccagctacttgggaggctgaggcaggagaatagtgtgaacccaggaggcggagcttgcagtgagccgcgttgctccactgcactccagccggggcaacagagcaagactccttctcagaaaaaaaaaaatttagccgagagaggaaagggaaaggctcttttgcattagagtttagagaactgattgtagagctaacaggcaacttgcaggccagcgttccctcaagtagaaatgaactctaatacccatgatcaagcccaggaacgtgttggtttcttttttctatgcctctaagaagttaattaattccagctgagtcctagcctttcctggccaacgtacctggctatctccacagtcaatctcacacctatgaaagcttatactttttctaagggatggtgtaatagttgggagagctaacccaggattagacaggccaaggtggtccaagttgggaatttaattatataagtgcataactcaccattttctacttttcctgacatatagatacaaaccctcaaaatgacaggaaagtaaattttaaaatgaaggaagggcaggaaggaagaaaagaagaaagggagttcaaatgttaaacattaaaatggtctactctcttgagtacacctgcagatattcctcaagttctagcattggcccatctctctctctttctcttccatgatgattttgtaacttaggtactgtttgccaaatgtccaacctaactttcaaacaatattcagagcagctgttttcaattctcatctttatgcagtgaactctgaaatccacatctctattttgttttttgttttttgagacgagtcatgctctgtcacccaggctggagagcagtgacacgatctcagctcactgcaacctccgcctcccggcttcaagcgattctcctgactcagcctcctgagtggctgggattacaggcacccgcaccacacccagctaatttttgtatttttagtagagacagggtttcaccatcttggccaggctggtcttgaactcctgaccttgtgatccacccaccttggcctcccaaattgctgggattacaggcgtaagccaccacgcccggccttatgtctctattttaatcttctcatttactctgggtctgtatttttagcacttactggacacctccacctggatgtgccacgacccttggccttgctgggcccaggaggaccttctgcttcctcccaaaccaacatcttctgtgttacctattcctgttcatgatggacttctgatgagcccggtcacccaggctctaggtaagtgggtctcaacttggctgaacactacattagcaagagggacattttttttttggagacagagttttcctcttgttgcccagactggagtgcaatggcgtgatcttggctcaccgaaacctctgcctcctgggttcaagcaattctcctgcctcagcctcccgagtagctgggattataggcatgcaccaccacgcctggctaattttgtttttttttttttagtagagatggcgtttctccatactggtcaggctggtcttgaactctgacctcagtgcctccgaaagtgctgggagccaccatgcccggcctaagaaggacatttttgaaagctccccagctgattgtaacgtgcagctagtgttaagaactactctgcctttctttcttttttttttttttgaggtggagtctcgtgctgtctcccaggctgatgtgcggtggcatgatctcagctcactgcaacctccgcctcctgggttcaggcaattctcctgtcagcctcccaagtagctgggactacagacacatgcccccacacctggctaattttttgtatttttagtagcgacagggtttcactgtgttagctaggatggtctccatcctgacttcatgatcctcctgcctcagcctcccatagcgctgggattacaggtgtgagccaccgcacccggcctactctgctttttgcaggctcacagttgcgagtccaatctgtgacttttacccctaacgtagctcagaaatctatttccttccttctttccaccctccttccctccctccctccctcactcccatcctccttcccttcctttctgacagagtctctgtcacccaggtgggagtgcagtggcacgatcttggcttattgcaacctccacctcccaggttcaagtgattctcctgcctctgcctcctgagtagctgggattacaggcatgtgccaccacacccagctaattgtatttttagtagaaatagggattcaccatgttggccaggctggtcttgaactcctggcctcaggtgatctgcccacctcgtcctcccaaagtgctgggattacaggcgtgagccaccgtgcccagctctatttccttctttctattcccagtattatccctttagtttaaacaccatgaaagcacatcttggtttcttgttttccctgctcctactcatgcctgacaaatcctttcaatgtatggttctgatcatattagccctcatttcaaaaccttcctgccatgtgccttagtcaggcagtcatatctgttaatgatgaggcccctgcctcttagccaagcttgttaagtatcctctactccccccattaaaaaaaaaaaataggccgggtgcggtggcttacgactgtaatcccagcacttcgggaggccaaggcgggcggatcatgaggtcaagaggtcgagatcatcctggctaacatggtgaaaccctgtctctactaaaaatacaaaaaattagctgggcgtggtggcgtgcgcctgtagtcgcagctactcaggaggctgaggcaggagaatcgcttgaacccaggaggcagaggttgcagtgagccgaggtcgcgccactgtactccagcctgggcaatggagtgagactccatctaaaaaataataataataaaaataaataatagaaaccgggcctcactatgttgcccaggctggtctcaaactcctgggcttaagtgatcctcccactctggcctcctgaattgctgggattacaggtgtgagccaccctgcttgacttctactccctttaatgaacgcttatgacaacgaaggaaagttgcttgcccttccctacacatgcccttttcctgcctctgtgcctttgctcacgcagtttccgccccctggggcaccattctgcacatgtctccatcctgtgttttcatcaagggctggcccaaatgctaccatctcccaggacagccttccctgatctgtccagctaggagtaaattcttcctttgaattctcttagaatttacatattctgtcaaaaaaccactgaagggagagcaatttgcaaaataatgaattgtttttctgctttaggacattggttctcaaaattgagtatacatgagaatcatttggagaactcatttcaaatgcataccccaggcagagcgtggtggctcatgcctgtaatcccagtactttgggaggccaaggcaggaagatcgcttgacgcttgagcctgggaggttgaggctgcagtgagctgtggttgtgccactgcacttcagcctgggccacagagcaagaccctgtcccccgccaaaaaaaagaagaagaagaagaagaggaacaagcctgttgcttatttcaagagattctcaggcttatttccagagattctcagttttttctcacatggtgttcctgtccaccatactttaagaaacattgagctaagaggttctttgttaatttcacgtcaggtggattcatgaatacgtcgacttgttggagtttcgtgatataaatccagccatactagcaaactgttaacagtcctgaaaacagtgtaaagtttttcatataccaggactgaaaactcaagtggatgggtaggttgagggttcactgctgaggaccacaggaagtggtaggactacaagggactacggagcatctctggtattcacctttcagtaacgatttccatctgagaatttggagcaactactgccagaatttccattttcccagaaagttggaaatccagaattttaggtgacatttccagattattacatggtaacttaaggttttaacaactctgtgaggtttgatataacccagttgcaattgatttaatccaacaattagctttcataattgaagtgtaaatagaagtaaatgttggtttgttttgctgcagaatgacataaaccattatttcatctatatagtgacaagaaatccacagaaatgaagagacaggctcattttaggatttcctggaatcattaatttttaaaaaattattttctctctccttccttccttcctctctcttcccttcctttccctttcctcttcctttcctttcccttcttccctttccttcctttctttttctctttcccttcccttccccttcccctttcccttcccctccccttcccctttcccttcccctccccttcccctttcccttcccctccccttcccctttcccttcccctccccttcccctttccctttccctccccctctccctttccttttctctttcctttcctttttctctctccctgtccaggggcccaatctcagctcacagcaacctctgcctcccgggttcaagtgattctccttcctcagcctcccgagcagctgggattacaggcccccactaccatgcccggctaatttttgtatttttagtagagacgaggatttgccatgttggccaagctggtctcaaactcctgaccttggccgggtgtggtggctcatgcctgtaatcccaccactttgggaggccgaggcgggcagatcatgaggtcaagagattgaggccatcttggccaacatggtgcaaccctttctctactaaaaatacaaaaattagctgggtatggtggcatgcgcctgtagtcccagctactcaggaggctggggcaggagaattgcttgaacccaggacgtggagcttgcagtgagccgagatggcaccaccgcactccagcctgggcgacagagcaagactctgtctcaaaaaaaaaacaaaaacaaaaaacaactcttgacctcaggtgatccgcctgcctcggcctcccaaagtgctggtattactgagccacctcccctggcctacagatttaaaatatatatcttttcatatttttagtactcagagatggatgattagatatagtgtctctctccattaaagtcaacaactgtgggccaggtacggtggctcatgcctgtaatccctgcacttcaggaggcggaggcaggaggatcacttgaggccaacagttcaacaccagcctgggcaatataggaagaccccatctctacaaaaaaattttaaaatgagccagtcatggtggcgtgcacctctagcccagctggttgggaagccaagctgggaagatggcttaagccctggagtttgaggctgcagtgagctgtgatggtaccactgccctccagcctgggcaacagagtgaggccttatctaaaaaaaaaaaaaaaaaaaaaaaaaaaaaaaaaaaaaatcaacaactgtggctggtggctcacacctgtaatcccagcactttgggagcccaaggcaggaggatcacttggagccaggagtttgaggccagcctaggcaacatagtgagaccttgtctctacaaaaataaaaaaagaaaaataaatcaacaggctgggtgtggtggctcacgcctgtaatcccagcactttgggagcccgaggcgggcagatcacttgagatcgggaatttgagaccagcctggccaacatggtgaaaccccgtctctactaaaaatacaaaaattagccaggcgtgctggcacatgcctgtaatcccacctacttgggaggctgaggcaggagaattgcttgaacccgggaggcggaggttgcagtgagcagagattgcgccattgcactctagcctgggtgaagaagcgagactctgtctaaaaaaaaaaaataaatgaaaataaataaataaatcaacaactgtattttaaattataagtgtagccccttgtttcattttactatttaagagacatgagtcatacttctatgctgtgctggaaatggcggagaattgacaagtatggaatttcccagcccccaactgtaggatcctgaaaatgacagaattgtaaacagatatttcacgttaatacaaagacctcagaataggcttttttattcccacgccagtcccatctttattctaacgtgccacgctccaatgcagcggttctcagcgtgtggcctgaggacccctgggattctggaggccctttcgatgggtctgtgaggcccttcgttttccaacttcatatccatgtgaggccagatactcttcatgtaattcaaccaaaacatcagactgcaatagattgaatgtagatatgagaaccagctgtcctctattaagccagatagcaaagagattcataaaactgtaaaacaatgccactctttatggtgtcttttgttttggagaatataattatttttaataaaaatgtgttctttacattaacatgatgggtttattgttcttttaaaatgaagtaatgaagtgtttttaaattttctcaattttagtttctaatatggtaaatatcaaaaaatatgatccacataaacgaacctcctggtgggttctttgtaatttttaggagcgtgaaagtgtcctgaaaccaaccaggtgcggtggctcatgcctgtaatcccagcactttgggaggctgaggcgggcagatcacgcagtcaagaaatcgagaccaccctggccaacatggcaaaaacccatcgctacttgctctgttgcccaggctggagtgcaatggtgtgatctcggctcactgcaacctttgcctcctgcgttgaagcgatcctcttgcctcagcctcccgagtagctgggactacaggtgtgcaccaccacacccagctatttttcttatatttttagtagagaccaggtttcaccatgttagccaggctggtctcgaactcctgacctcaggcacctgctttggcctcccaaagtggtgggattacaggcgtgagccaccatgcccatttttcttattccaacattatctcttgatctcacaactctgatatctagtcagaaatccttcttttttcttttcttttctttttttttgagacagggtctcgctgagttacccaggccagagtgcagtggtgtgatcatagctggtgtggaactcctgggcccaattttaaagttgcagaggccaggcacagtggctcactcctataatcccaacactttgagaggctgaggaaggaggatgacttgaggccaggggttctagatttgcctgggcaacatagtgagaccctgtctctccaaaaaaaaaaaaaaaaaactgaagaaactgaggttcacaggttactaacacggttagtaaataaataaatcagaaataagattaatcttgtagggctgggcacggtggctcatgcctgtaatcccagtactttgggaggccaaagtgggtagatcacttgagcccaggagttcacgaccagtctggggaatgtggcaaaaccctatctctacaaaaaaatacaaaagttagctgggcgtggtggcatgcacctgtattcccagttacctgggagtctgaggtgggaggattgcctgaggcccaggaggcagaagttgcaataagccaagatcacaccactgtactccagcctgggtgacagagcgagaccctgtctcaaaaaagcagaaacaatgattaatcttgtagctcttccattacaatttatgtcttttaaaaatgctcctctctttttgtctttccttccgagtgtttttttctatcctctctctgaatgcaacaagaagggaagtggggaatggagaccaatagcaaaatagaaccatctcttctaaaccttttgccttgcctctctgcttaaagctgctatcatttcatcattaattaaaggcgatggagcaaaggtccctgggttgtcatttgttgctgttgcaccatctaacattgatttgagtgtttataatggggttggtactattcagaatatctgatgacaaatcttggcttctatctttttttgtttttgagtttcactctgtcgcccaggctggagtgcatggcgcaatcttggctcactgaaacctcagtctcttgggttcaagcaatttccccctctcagactcccaagtagctgggactacaggcaccgaccaccatgcccacctaatttttgtatttttagtagagacggggtttcaccatgctgaccaggctggtctcaaattcctaacctcaggcgatccacctgcctcagcctcccaaagtgctgggattagaggcatgacccactgtgccagccaatttgtctcacctgaggtcaggagttcaagactagcatggccaacatggtgaaactctgtctctactaaaactacaaaaattagcggggcatggaggcagatgcctgtagtcccagttactcagggggcgggcgggggcgggagaatcgcttaaacctaggaggtggcagttgcagtgagccgagattgccccactgcactccagcctgggggacagagtgagactctgtctcaaaaaaacaaaaaaaagaaacttggcctctatcttattgcagtgtttgcagcagcaggggtaaacccaaagtatcagctactcctacaattatttctaattagtttataagaggttctttgtaattaccagagaattggggtctatctgaagtttaggggcatcataatacttcaaaaaaataacaaacctatgctggagtgactcctatgggagacttagagctctgtggaatttcccacactcaccctccactctgctcctcctggccacactacccatgctgggaaattcatcccttctcatcccactgcaaggtaccgttctgtttctctcacactaaaattgctttcttccaaggtgtccctggggctaaaacagataattaagaattttttcgctgggcgtggtggctcacacctgtaatcccagcactttgggaggctgaggcaggtggatcacctgaggtcaggagtttaagaccagcctggccaacatggtgaaaccctgtctctactaaaaataaaaataaaaaaattagctgggcatggtggtaggcgcctgtaatctcagctacttcgggaggctgaggcaggagaattgcttgagcctgggaggctgaggctgcagtgagccgagatcgcaccattgcactctggcctgggcgacaagagcgaaattctgtctcaaaaaaaaaaaaaaaaaaaaagatttcaagacgaagaaatctcaaacttctttctctgggctaccactataatataaaaacaagaattcaacagagataataatgccttaaactttttaaaaagattactagttggagcttttcttacttttctcaagtatatattctttactataatgtctgttcagctttcagaaaattaacaggttatattgtcaaaaaggttttccaaagttctaggttataaactacagctctgtaacaggaataggggaggaaaaagcaggttagagacattccattttttactttatagcttgaaaattgctttaattttcatgcaggaagcaggtattgcttttgtaattgaggctttttaattaaaaaaaattttccccattgtttaatatctggaaaaaaataatcttaacttcaaagtgttagctattatcctatgttgttatagtagagagctttttgagacaaaaattacttctagctgatgcttttataatccagaatcagattttaaagcaggtgcagatcctaagtgaagcacaagcctgtatcttcttgaagtagggtaacattttctggattctgcagctatgaattacaggatataaaatttatcgggcagctctcagaaccaggacaggctcagaggggttcgaggacaatattttaaaatattaactgaaatctccttcacaattttttatattgtccttttcccattaggaaatttttttttctttttttgagatagggtctccctacattgcctaggctggagtgcagtggctattcacaggtgcgatcatagcacagtacagtcttgaactcctaggctcaagcaatcctcctgcctaagcctcctgagtagctgagactccaggcatgggccatcatatctggtttgatatctagaaatgtatcaatacatttgcagtagtctaaaaaagcaaactcatcaatttactgaaaactgaacagatatatagtaaagaatatatacttgagaaaagtaaacaaagctccaaatagtaatccttttaaaaagtttaaggtggctgggcatggtggctcacgcctgtaatgctaccactttgggaggctgaggcaggtggatcacttgacatcaggagttcaagaccagcctggccgacatggtgaaatcccatctctaagagaagcacaagcctctgtcttcttgaagtagggtaacaaatacaaaaattagctggggatggtggaagatgcctgtaatcccagctactcgggaggctaaggcaggagaatcgcttgaacctgggaggcagaggttgcagtgagccaagatcgtgccactgcactccagcctgggcaacagtgtgagactctatcacaaaaaaaaaaaaaaaaaaattaaggtgttattatctctgttgaattcttatttttatattatagcagtagcccaggaaaagaagtttgagatttctttctcttacttagacaccttcttagcctgatgccagaagtctacagcagatttcagaggtgatgcagaaattttagaatttcccttcccttcccttcccttcccttcccttcccttcccttcccttcccttcccttccctttccttcccttcccttttcccttcccttccctcccctcccctcccctcctctcccctcccctccctttccttcccttcccttcttttcttttatttattttcttttcttttatttattcttttcttttcttctctttctctttcttttatagggtctcagtttgtcacccaggctggagtgcagttgtgtgatcatgattcactgcagcctcaaccttctgggcttgagtggtcctcctgcctcagcctcctgagtagctgggaccacagcatgtaccaccatgtcctgctaatttttaaattttttagagacagggttttgctatgttgttcaggctggtctcaagctcccggactcaagcagtcctcctgcctcagcctcccaaagtgctggaattacaggcaggagtcactgcgcccagccgatgcatttctttaagatagggaacatgacaatgttacctccattgtccttgaggccacttacctttgtcctccctgccatatgtcctgctgccaattccccccaacatttggcatacaataggaggcttccagctctatgccaagagaggaggtacatgcaagaggtaagagcaggaagggaaatagcaaaatgatcagtatttcagatgatataatcatttctattaaaaattcaataaaattggctgggtggggtggctcacacctgtaatcccagcactttgggaggccgaggcaggcagatcacctgaggtcaggagtttcagaccagcatggccaacatggtgaaaccccatctctactaaaaattagctgggcatagtggcatgcgcctgtatctctcactatttgcaacagtaatagtaatagtgggctacttcactgagcacagccagagctgggagctggatggtatggaggtctctctaattgaggagatggaattgaaagttcagagaaaccaaggcaggcagagtttataaggcagagaactggagaggagacagctgcacaagtcaaggcctccagagagctgcagagggtgcccctaagctgcccagggcttacaggggagacaagcacctaaggccagggaaagaactacctgaaagaagcaggcacaagaatccaagctcccaaagggctgggagtagttgatattttcaaaagctggtgagaaaaaatcatcccagaaaggaattgcctcaggaatagagaaaaactagcctaggacatcgaaggtgactcaggtcctatctggtaaatctccaaaggatcaaactgttcccaagtaactcagcagtgtcctagaacagagctcaagaattttttaaaaatataagaatttggaaactcagtctgaaaaaaaaaaaaaagaattaatacagcaaacttctctagatccaggtagatcatctactccccaggtagatattcaataaagatttactgcttggctctttgaaagaaagtggcagcagggcctggtggctcacacctgtaatcccagcactttgggaggctgaggtgggtgaatcacaaggtcaggagttcgagaccagcctggccaatctggtaaaaccccgtctctactaaaaatacaaaaattagctgggcgtggtggcgggcacctgtagtcccagctactctggaggctgaggtaggagaatcacttgaacccgggaggcggaggttgcagtgagccaagattgcgccactgcactccagcttgggtaacagagtgaaactttgtctcaaaaaaaaaaaaagttagtgaacttaaagacacatcaatagaaactttaaaatgaaacaaagagaaaaagcctttaaaaaaatgaacataacatcactaagtgaaacaactttgcatacctaatatacatgaagctggagtactggaagaagaggggaaagagaagggacatttctttttaagaaataatggtgggctggcatggtagctcatgcctgtgatcccagtactttgagaggctaaggcgggtggatcacttgagcccaggagttttgaggccagcctgggtaacatgacaaaaccctgcttctacaaaaaatacaaaaaaattagccaagagtggtgacgcatgcctgtagttccagctacttgggaggctaaggtggaaggattgcttgagcctgtagtcagaggttacagtgagctgagatctcaccactgcactccagcctaggctacagagtgagactctatcttaaaagaaagaaagaaagaaaaggaataattgtcaaaaattttctgaatttgatgaaagctataaacccacagatccaagaagttccgtgaaccccaagcaaaagatagaaacaaaaaacctacattaagtcacaagtataataaaaatacataaaactagtgttaaagagaaaatctaaacagctgtaacagatacttgatataatttgtccagagggataaaaataagaatgacagctcacttcttgccaaaattttgttatatgagatgaattgtgcttagctgtgttttgtgtttttgtgttttggtttttggtgttttttgaggcagagtctcactttgttgcccaggctggaatgcagtggcataatctcggctcactgcaacctctgcctcctgggttcaagcgattctcctgcctcagcctcctgagaagctggaattacaggcacgtgccaccatgcccatctaatttttgtatttttagtagagacgaggtttcaccatgttggtcaggctggtcttgaagtcccgacctcaggtgatccgcccacctcggcctcccaaagtgctgggattacaggcatgagccactgcgcctggcctactgtgttttgtgtttaactgagttttccattcctaagagcagaagacatccttcctgatggaatagtgctttgtatatatctggtaaattatgcagaatacacatttattttaccgtcttagtttttactgcagaggaggaaaataatgatacattttctgttactcatttagtagaaatttcctacttaaagaaataatacgccagacgcggtggctcacgcctgtaatcccagcactttgggaggccaaggcaggcagatcatgaggtcaggagatcgagaccatactggctaacacggtgaaaccccgtctctactaaaaatacaaaaaattagccaggcgtggtggcgggcgcctgtagtcccagctactcgggagactgaggcaggagaatggtgtgaacccgggaggcggagcttgcagagagctgagatggcgccactgcactccagcctgggtgataaggcaagactccgtctcaaaaaaaaaaaaaaaaaaagaaataataaattaagaacatgatcctttttaaaaattatttcttgagatggagtctcactttgtcacccaggctggagtgcagtgggcctatcttggctcactgcaacctccacctcccaggttcaagcgattctcctacctcagccttctaagtaactgggattacaggcacccaccaccacgcctggcttattgtagacaatgatccatttacgggcaacacaaatatatgatagtggtgacagtcataattagtgttttgtgactgcctttgtatagaactttagtagggatttcatagatataatctaaatgacatatcctcaatatctgtgctccttttcttttttgagataaagtttcaccccgttacccaggctggagtgcagtggctcaatcatagctcaagcagtcctcctgtatagttgggactgtgcgcacatgccactgcaccctgattttatatatatatgttttgttttgttttgttttgtttttaagaaggagtttcactcttgttgcccaggctggagtgcaatggcatgatcttggctcactgcaacctctgcctcccgggctcaagtgattctcctgcctcagcctcctgagtaactcgggttactggcgccccccaccacacccggctaatttttgtatttttgttagagatgggttttcaccatgttggccaggctggtcttgagctcctgacctcaggtgatccacctgcctcagcctcccaaactgctgggattacagttgtgagccatcgtgcccggcttttttattttattttatttttagtagagatgaagtcttgttatgttgcccaggttggtcttgaactcctgggctcaagcaatcctcttgccttggcctcccaaaatgtcaggattataggtgtcaaccactgtgcccaggcatttttccttttctagtaacaagaatcctgatttttttgctgggcacctggctgtgaacactacaatgctcagcccctcttacagctggagtgggcaccttctggaaatcatccttccctttctcctctttctcctggccagcacgcagaggagcaggccagggctgagacagctggcatggaccacctgaggccatggagtgacgtgcagccaagagcctgacagaggagtcagggtccctcacccagggatggcagaaccagccttgattttatctaagggagagatggacttctatctgctcaagccactgattgttggcattttcattacttgctgctgaaccttatcttcattaatacaaataggttgtcattatatattttcttttttctttttttcttttttttttttttttgtttcagagtctcgttctgttgccaggctggagtgcggtggcgcaatctcgcctcactgcaacctctgcctcccgggttcaagcaattctcctacctcagcctcccaagtagcttggattacaggcacccaccactacgcccggctaacttttgtatctttttgtagtagagatagggtttcaccatgttggccaggctggtctcgaactcctgaccttgtgatctgcccacctcggcctcccgaagtgctgggattacaggtgtgagccactgtgccaggctgtcattatttatttcctaaaggcattagacaagttcctaagacatggcaaaatttgaatatgaaccaggtctgttttctgtaaaactttgttattttcagtaaattattcttcttaccactaatgtttacaaaaatggcagctgtatactattaaagatttgcagagaatacaaagtcaaaatatcagtagccactgagagctttaactgaagctctcagataaatatttaaagacctaggacttttaaagggactatttacagtggaatagtgtcataaactgaattttgaaaaaacaaacagaaagtgtaaaagaaagctctccaagggaccaatactttaatttcaggagtgttctcatcctttgtaacatggtattttctatatagtgtgaaaggaaaataaatcttgggaccccaaaattactaagccaaggaaaaagtcaggctgggaagtgtcaggcaaacctgcttcccattttattcctaaataagatagttacaaagataaaaaagctatatacctcatgtaatcatgattgtggtatttttatttcttatttatttatttatctttttgagatggagtcttgctgtgtcgcccaggctggagtgcagcggcgcaatctcggctcactgcaagttccgcctcccgggttcacgccattctcctgcctcagcctcccgagtagctgggactataggcgcccgccaccacgcctggctcttttttttgtatttttagtagagacggggtttcaccgtgttagccaggatggtctcgatctcctgacctcgtgattcacctgccttggcctcccaaagtgctgggattacaggcatgagccaccacacctggcctgattgtggtattttaaaaaaaaaagaaaaaagaaaaaaagtaaattagaaaaaagctacatggctgggtgtggtggctcacgcctgtaatcccagcactttgggaggccgaggcaggcagatcacaaggtcaggaatttgagaccagcctgaccaacatggtggaaccctgtctctactaaaaaaatacaaaaattagctaagcgtggtggcgcacacctgtaatcccagctacttaggaggcttgaactcgggaggcggagattgcagtgagccaagattgcaccacggcactccagcctgggcaacagagcagactctgtcttaaaaataaataaataaaaataaataaataaaagctacataccttcctcacaatttgcccccagagaaattccttgtgggcctcaagatctttaccctaaaacagttctgttgaatttcaccctggcaatgtaaattgatagcttatctttacagatgagggaccgtccctctgctcacctgagacaaaggcatatctgattgcttcctctactggttatgtaaaaatgcagattcactgagtcatgctcagttatgtattcagtgaaaggctgatcaaggactccaaagaatgcaacctttttttttttttttttttgagacagagtctggctcagttgcccaggctggagtgcagtgaggagatctcggctcactgcagcctctgcctcccaggttcaagtaattctcctgcctcagcctcctgagaagctgggactaaaggtgcaccaccatatccagctaatttttgtatttttttggtagagaaggggtttccctgtgttagccaggttagtcttgatctcctggtctcaagtgattccccctgccttggcctcccaaagtgctgggattacaggtgtgagccaatgtgcccggactagaatgcagtcttttgtctcttatctacctggacctggaagccccaattttgagttgtcctgccttttgggaccaaaccaatgtacatctttttttcattttttatttttttgagatggagtttcgctcttgttgcccacgctggattgcaatggcacgatctcagccaactgcaacctccgcctcccgggttcaagcgattctcctgcctcagcctcctgagtagctgggactacaggcgcccgccaccatgcctgtttaattttgtatttttagtatacacggggtttctccacgttggtcaggctcaaactcccgacctcaggtgatccacctgcctcggcctcccgacctcaggtgatccacccacctcggcctcccaaagtgctgagattacaggcatgagccaccgggcccggccaaaccaatatacatcttacacatattgattgatgtctcatgtcactctaaaatgtataaaagcaagctgtatcctgaccattctggcatatgtccgcaggacctcctgaggctgtctcacgagtggtcattagccttggcaaaatcaactttctgaaatgactgagacctgtctcagatattttgggttgacaatacacacacacacacacacacacacacacacacacacacagagttttggtgacagggttagagaaaaataatatctactttcatggcttacaactctggttttacaacagaagtaaaaaaaattttattctaatagcatgatttatctttgccaatttttgaaaatttttattttattttattttattttttggagagaagtgcacagtcatagctcatcagaacagaatatcttaccaggaggcatgtcacccttgtctccttaaaacctttccccgcacacacacaaaacactctcattttggattttgtgcctatgttcatgtcattccctctgtttgcaattgctttctttcccaccaatcaactaactgcgctaattactaagtcttgatcttctcctccatgaaggcttcctggattggtctagtctacaacagtagttctcaaagcacagtacggcagcagcagtgtcacctgggactggaaattcactcctgcaaccccagacctactgagctggcaaccctggggggcccagcactctgtgtcattgagtctaagatgcttttgatgtgactcagattagcttgtcactgctctaaggccatattgatccctcccttctctgggtccccatgccacgtacagttcacagtacatcacttggagctgaatccccttttaaagaattgttatagtaggcttccctagattcaggtagattgtctactccccaggtagatattcaataaagatttagtgcttggctctttgaaagaaggtggtggctcatgcctgtaatcccagcactttgggaggccaaggtgggcggatcacaaggtcaggagttcaaacccgcctgcccaatctggtgaaaccccatctctaaaaaaaatacaaaaattagctgggtgtggcagcgcataactgtaatcccagctacttgggaggctgaggcaggagaatcgcttgaacctgggaggcggaggttgcaatgagctcagattgtgccatagcactccaggctgggcaacaagagtgaaactttgtctcaaaaaaaaaaaaaaaaaattgaatgctaaaggtcaccgcagcaatcaatgtcatcttctgttgctgtggatgtttatgttattattattattattattgagacaaagtctcgctctgtggcccaggttggagtgcagtggtgtgatcttggctccctgcaacctccacctcccgggttcaagcaattctcgagcctcagcctcgcaaatagctgggactacaggcccgactgatttttgtattttagtagagacggggtttcactatgctgcccaggctggtctgtaactcctggcctcaagggatctgcccacctcggcctcccaaagtgctggcattacaggcatgagccaccacgctcggctggatgttcatattaacacaagatgctgtatcaagacccacgcgatactgaacagacatgacccttatccttacatgtgaagatgtggaatggtcctctcaggtacatgactccacagggaatgtatatattgtcataataattctacttactaactttgattgagcacctattgtgtgccaggtaatgttctcagcaggactagctgcataatttgcagggctcagggcaaaatgaaaacacagggctccttgttcgaacagcagagaaaagtgctgttaaaggtaccaagtacaggccgggcacagtggcttgcgcccataatctcagcactctgggaggctgagctgggaggatcgtgtgagctcaggaatttgagaccagcctgggcaacgtagtgagacctcatctctacttcagaaaaaaaaaaaatcagctaggcgtggtgttgtgcacctagtcccagctactcaggaggccaaggtgggaggcctgagcccgggagttcaaggctgcagtgagctattactgcaccacagcatgccagcctgggcaactgagcaagaccctgtcttaaaaaaaaaaaagggtaccaaatacaaagtattctttttttcatgatctatctgtgtaactgtcctgtttgtaaatcttctgttgaatattatactccctgcagcatcaaggatgctcctggaggagtggggacgctcccaagggctggggtccctgccctaccattctgtgttcacaggcgcatccatctgccactgagccccactctgactagccactagaccaatgcaccatgccctggctaggggccaggagcctaccacccaatctgtggcagagaggtcaccctccaaggcattgcaaagtttgcaccagcacacactaggtacctgggtaggcagcaggcaagaggcttgcccccaccgggggtgctcgggagcatgctgtgtgctcaagacaccagggaacacgtgccttaccctgatcctcctgcacccacactcaggccctgcccagagtgaagggtggccaggtggccaggtgggagtggggagggggccatggaacccagggtgcaggggacaggggaatgggcagtcaggaacctgccagggggaggcagggaggtgggaccacacactgcactacaagtccatgatgcatgcgcactccattgccctgtgggaacagaaattcaaagacaaaatcattaagaatttcaggctgggtgcagtggctcatgcttgtaatcccagcacttcgggaggctgaggcagatctcatgaggtcaagagttcgagaccagcctggccaacatggtgaaaccacatctctactaaaaatacaaaacttagctgggtgtggtggcacgcacctgtaatcccagctactcaggaggctgaggcaggagaatcacttgaacctgggaggcggaggttacagtgagccgagatcgtgccattgcactccagtctgggtgacaagaacaaaactccatatcaaaaaaataaaaaataaagaatttcaagatgatgactgcagaacattcagtcccaagtgtgggacccttttgagcatggggacgctgtgtcacggcactaacagcatacccctgaagccagcctcgttctgagacttttgtgagacttattaaatctccacgcaagcctataagggtattgtccccaattagcagacaaggaagttgaggcatagacaagtggcctgcccaagattgcttagctgggcggatgggtggggtgataccagcccagtctcacccacatctgcctgcttcaccttgctcattgctgctcttcagagaatatttgcagagcaatagaaattcagaaggacagccaaatagttacagctcatgctcgtccagttggcattaaagctctgtcctcactgcagtccccaccccccaccaatggtttgttgatcctctcccatagcagaagcaggaacactgaaaccatgataggtatgagctcaggagacgttcccaggagatctgcctatggccttggggaaaactggtagagctggttggagctggccctctccccagctgccttccacaattagctcagggggcacacttagtccctcctggaggtttcacgacctggcaccagatgcagaccctggtcagctctgttaaggaaggactctgtgagcaggtgctggtgtcagccaggacttggggtaatcttctagaactttactgtagttttttcagtgtccacacttcctggaattcgtctagtttatttcactgaaagtgggcaggatctttgaaaagacactctcaaaagaattggattccccttatctattcagcatttcctttgtcaccaaagtgatcagtcagaagtagttagaaagtagccccaacacggccgggcacagtggctcacgcctgtaatcccaggactttggggggccgaggcgggtggagcacgaggtctggagttcttagaccagcctggccaacatgatgaaactctgtctctcctgacaatacaaaaattagctgagtgtgatggcaggcgcctgtaatcccacatactcaggaggctgaggcaggaggatcgcttgaacccgggaggtggagattgcagtgagctgagattgcaccactgcactccagcctgggcgacagaatgagattctgtctcaaaaaaaaaaaaaaaaaaaaagtagcctcaaaaatttagacaaactagtggtgtgctggtaattgttttgtaaacagctctctggaatacattttttttttcttttttttttttgaagcggagtctcattgttgcccagacctgagtccagtggcctgatcttggctcactgcaacctctgcctcctgggttcaagtgattttcctgtctcagcctcctgaatagctgggattacaggtgcctgccaccacacctggctagtttttgtatttttagtagagatggggtttcaccatgttagccaggctggtctcgaactcctgacctcaggtgagctgtcctgcttggccccccaaagtactggaattacaggtgccaccgtgcctggcctggaatacatttttttcaaaggtgctgtttgtagcttttaatgatttctatggtgctgatattccactaaaacaaatttcaggctaccagggtgatatctccctggttgcaaaatccctgaaattttgccagtctgctcctgcaggctggtaagacccaatgtgtttccgtccagcacacctcttgacatggaccttccatcaaggacaccaaagtgctttaggtgagtgtcctaattgttccagtgatttgggggcaagctggaacaaggaaaaagagctataatacagtcatatcaattttacagctgagcatactgaggttccaacacataatattttgccgcgggtgccccagcaaaggcccaagccttagataaggaggctgttgaacagcttccagctgagaccatgtcacatggctgaggtatggagatggctaaggtgtgccaccctagaggctatagtctttaggaaggaaagaccttgagaacaagaggaagtagtgaccagatgcctaagtggcgtgattgattgattgattgattttgagatggagtttcattcactcttgtcgcccaggctggagtgcagtggcatgatgttgctcgctttaactttggcctaccaggctcaagcgattctcctgcatcagcctccctagtagttgggattacaggctcccgctaccgcgtccagctaatttttttgtattttttgtagagacggagtttcatcatgttggcctggctggtctcgaactcctgagctcaggtgatccacccgcctcggcctcccaaagtgtggggattattattattattactgagacggagtctcgctctgttgcccaggctagagtgcagtggcacgatctcagctcactgcaacctccacctcccaggttcaagcgattctcctgtctcagcctcccgagtagctgggattagaggcatacgccatcacgtttggctaatttttgtctttttagtagagatgggctttcaccatgttggccaggccggtcttgaactcctgacctcaagtgatctgcccccctcggcctcccaaacttctgggattacaggcgcgagccactgctcccggccattgtttttgagacaagatctctgtcatccagactggagtgcagtcgcatgatcatggctcactgtagcctcaatctcctgggctcaagcaatcctcccgtctcagcctcctgagtagctgggaccacaagtgtgtaccaccacgaccggctaatttttttgtttttttattttttagtagatatgaggtctgtctatgttgtgcaggctggtctcaaactcctgagctcaagtatgctcctgccttggcctcccaaagtgctggaattacaggcatcagccaccgtacctggcctacccggtgtgatttgaaagatgctgcgaaattctcagaggagggatagatgctctaggcctctcctccatactcaggagagataacatggggatggtggcaaaaagaatcaagtgacttcaacaatttcatttagttgtagaaaaagcattgaccctggctgggtgtggtggctcacgcctgtaatcccagcactttgggaggccgaggcaggcggatcatgaggtcaggagatcgagaccatcctggctaacacagtgaaacccctctctactaaaaatacaaaaaattagctgagcgtggtggcatgtgcctgtagttccagctactcgggaggctggggcaggagaattgcttgaacccgggaggcagagcttgcagtgagccaagattgcaccactgcagtccagcctgggtgaccgatcaagacttcgtctcaaaaaaaaaaaaaaaaaagaaaaaaaagaaaaaaaaaaagcaatgacccataaagaaagagcctgtttgctcctatatatttaaatcacatttggccgggtgcggtggctcacacctgtaatcccagcactttgggaggctgaggtgggcagatcacttgagtccaggagttcaagaccagcctggccaacatggtgaaaccccatctttaataaaaatacaaaagttagccgggtgtggtggtgcgtgcctgttatcccagctgcttgggaggttgaggcatgagagttgcttgaacttgggaggcggaggttgcaagatcatgccattgcactccagcctgggcaacagagtgggactctgtctcaaaaaaataaaaaataaaaacaaataaataaataactcacatttgactgccagctggatttctcttgagtttttctcctatcacccctcctccaatattcttactagtatcaccatcgttaccagtattcatcgtatatattctcagagttttctttaatcaaacttggccttgctagctcttagaaagagtttccattagggcaacattactatcaaatatcttttttttttttttttttttttttttgagacggtctcactctgtcacccaggctggagtgcagtggtgctatctcagctcactgcaaccttggcctcctgggttcaagcgcttctcgtgcctcagcctcccgagtagccgggactacaggcatgcgccaccagattcagctaatttttgtattttttggtagagacaaggtttcaccatgttggccaggcggtttcaccatgttggccaggctggtcttgaactcctgacctcaagtgatccgcccacctcgtcttcccaaagtgccaggattacggttgtgagccaccacgcccagccccaaatatctctttatatagctatgggtggctacgagggacacatttgatggaatgcgatccgaggcctctggagagatttttcatgggcatgtatctgttgggaagaacctcagggtggaggccattcctctttctaaattagctagtgtagaagacagggcaaagttctcataaaatttctaacatcgacgagagtgttggcattagaaatgagaagacagaaaaagtatgaaaatgcaaaaatggaaaatgtacataaatacaaaattttattaaatagtattcattgattttaaatgtatacaacatgcttgttggtatttaaaaatagaatgatggaggatgatttggtgggagtaattgtttgaaaaaaaaatcaatttaacatcactttgctttccacttctgctgccaagaaatctcaggcagtatcttctaattcaaacataagtgtctccagaaacctttggatcacatattacaaagccccatctgttttaccctctcaaaattagcattttagcttaattcacttatacattttctgacattagcttgattcttctcttcttcctttttgtcatcttaaatcacacctggcatcttttagatttggattcaactgaaaaaataatttttagctattttaagtcctttttagtagtaagcagagtgtaaataaaatttaaagcataatgatgcaaacatatatacagctaatgtttcttgcaggattgtttacaatagcaaaaactggaaacaaatgtctatggattgagaggtggttaaaacaataattgctaaatcattaataattcttaaaaggagtgaaatatatatgtgtgtgtatatatctatatcctgatatgtatgcaaggctgtatatgatctatgtaagtggaaaaaagcaagttgaaaaaacagcaaacagatagttttatatgttgaaaaaaatcaaggctgttcaaaaaaggtatctttgtgtaagggcatagaaagtagcttgcaaggcacacactaagtgaggaatgtgatttgctctggaggggaacagggtaaaggcaaaggtggcaaggggacagtcccatttttcccgtcggcttctggtatgcttgaattttctacaatatgaatgtgtgggccggcgtggtggctgatcacaaggtcaagagttttagatcagactgaccaacatggtgaaaccctgtctctactaaaaatacaaaaattatccagacatggtggcgtgtgcttgcagtcccagcgactcgggaggctgaggcagaaggatcgcttgaacctgggagagcggttgtagtgagctgagatcgtgccactgcactccagcctaggcgacagagtgagactccgtttaaaaaaaaaagtgtgcatgtatgtgttattttgcaattagaaagtccaaaccaaggccaggcatggtggctcatgcctgtaatcccagcattttgggaggcagaggcaagaggatcacttgagcccaggagttcaagaccagactgggcaacatggcaaaaccccatctctacaaaaaaaaaaaaaaattagcagagtttggtggctcatgcctgtagtcccagctatgcgggaggctgagatgggaggattacttgagcccagcaggtaggggctccagggaactgtgttcacaccattgcactccagcctgggtgccagagggagaccctgtctcaaaaaaagaaaaaaaaaatccaaagcaaaaactattaaatgaccaagcatatataataaaataacacatgtcacaagggccatcacaaatttctgaaggtttcctttctactcctattttgaatcatttcctactcaaggcaaaataaaaagaatttttaaaaaaaattttaaaaatagagatggggctgggcggggtggctcacaccagtaatcctagcattttgggaggccgaggtggatggattgcctgaactcaggagtttgagatcagcctgggcaacatggcaaaaccccatctctactaaaaatacaaaaaaaatagctgggcattctggcgtgcacctgtaatcccagatacttgggaggatgaagcaggagaattgcttgagcctgggaggtggaggttgcagtgagccgagatcgtgccactgcactccagcctaggcaacagcacacacacaaaaatcataataaaataaataaacagaaatagagatggggtttcgtcatgttgcccaggctggtcttgaactcctgggctcaagtgatctgcccaccttggcctccgaaagtgctgggattacaggtgtgagccaccgaacccaaccaaaaagaaaaaacttaaaacacatacaagagaggaactttattagtattgaagataacgagtgtataactatctatctagtaagcataaagagatgttaattttcagtagaatacaagatagaggtaatatatatttgtgtgtgtacaattttgttttgtttatggggaggacattttcttcaccatcatcatcatcatcatagtcattgatgtcatgtcaactgccattactgtatggcaggcaatgccttaagtttacttttattaactcacctaatcttaactacagcccaattaggaaggttctatggttattcccattttacaggtgagaaactgaagcagagagaggttaaggaactcggccagggttacacagcttgtaagtgggggagctgggattcaaatccaggcaggatgaatccagagtccatgctcctaacctcaactctacacgcgagaagccaaatgaacacattcattcgtatgcaggtatctctctggggtggagagtcctgtgttcctgcagaggctcgtccagcaccatctcctctgcatgccaagtcttccctcagcaatttctcaacacaccctcaccttttttagagacagagtctcactctcttgccgaggctggagtgcagcggcaccatcatagcttactgcagccttgaactcctaggttcaagcaatccccctgcctcagcctggcattacaggcacgtgccaccacgcctggctaattttttatttttttgagacagagtcttgctctgttgcccaggctggagtgcaatggcacgatctcactgcaacctccacctcctgggttcaagcaattcttctgcctcagcctcccgagtagctgagactacaggtgtgtgccaccacgcccagctaatttttgtatttttagtagagatgggatttcaccttattggccaggctggtctcgaactcctgacctcgtgatccatctgcctcagcctccccaagtgctgggattacaggcatgagccagcacgcctggctttttttttttttttttttaactttttgtaggcacagggtcttgctatgttgcctagtctggtcctgaactcctgacctcaagtgaccctcctgactcaccctcccaaagtgctggaattataggcgtgagccactgcactcagcctacttctcccttttacacaatccacttttccttggtatcctcccacctcagccttccgaagtgttgggattataggcgtgagtcactgcaaccggcccctgttccttgttttttgtttttgttttatttttattttggtcctgcacttggttgaggagataagcttgccttgagaagcaattataaaaaagagaggaacaccagagaaatgggggtctcagagttgtgatggtggtttggggcaaggaataggaagtaaggaggtcaccatgggacactggtgatagaagcagaggggaaaggctgggcgcagtggctcacgcctgtaatcccagcactttgggaggccgaggcaggtggatcacgacgtcaggagatcgagaccatcctggctaacatggtcaaagcctggctctactaaaaatacaaaaaattagctgggcgtggtggcgggcgcctgtagccccagctactcaggaggctgaggcaggagaatggcgtgaaacccgggaggcggagcttgcagtgagctgacatcgcgccactgcactccagcctgggcgacagagtgagactctgtctcaaaaaaaaaaagaaaaagaaaaaaaaaaaaagaagtggaggggaaactagcccgggcgtggtggctcacacccgtaatcccagcactttgggaggctaaggcaggtggatcatctgaggtcaggagtttgagaccagcctggccaacatggtgaaaccccatctctactaaatacaaaaatttagccagacgtggtggcacatgcctgtaatttcagctactcaggaagctgaggagggagaatcgcttaaacccaggaagtggaggttgcagtgagctgagattgtgccattgcactccagcctgggcaacgagagcaaaactctgtgtcaaaaaaaaaaaaagtggaggggaaactagacaggaaagctatgacttagtaattaatcagcagcagcagcaggtgcaggaacaacccttaggctttctcgtatgtggttttgttgaactagctctgtagcggaggactgtacctatcactttttgtagataaaaaggaagtaggtgaagttgaatgatgagcaatcaaaaataaaataaaaaggaagtagaagtcagcttccaaactcaaggaatttttttttttttttgagatggagtcttgctctgtcacccaggctggagtgcagtggcacgatcttggcttactgcaacctctgcctcccgggttcaaactattctcgtgcctcagcctcccgcgtagttaggattacaggcgcccaccaccacagccggattttttcttttttttgtatttttagtagagagagggtttcgccatgttgcccaggctggtctcaaactcctgagcttaggcaatctgctcgcctcggcctcccaaagtgctgggattacaggcgtgagccatcacacccagctgaaactcaaggtatttataatttatggtaatatgataatgatatccacagatgaacacagaaagaaatagatgatagatagacagatagagctaattgccagtaaagaaacaaatactggccaggtacagtggctaacgcctgtaaacccagcactttgggaggccgagtcaagcagatcacctgaggtcaggagtttgacatcagcctggccaacatggtgaaaccctgtctttactagaactacaaaaattatccaggcgtggtggtgggcgcctgtaatcccagctactcaggaggctgaggcaggagaattgcttgaacctgggaggcggaggttgcagtgagccgagattccgccactgcactccagcttgggctacagagcaaggctctgtctcaaaacaaacaaacaaaataaaaaaaaaaaaaaaaaaaaaggaaaagaaatactaagcagagggtttgggttttagatcacatgtcagctccagcttcgttatgccgtctggggtagcctccttcacctttcccagagcctgttttcccagctttattacaggtagatgactcctatgtcattgggttgcagtgaggaccagacgaggtaacacacgcagaagagacctgtagagccccactggggtgcttcctgcccaatccctccttccctcccaccctccacaggtgtcagacccgtgtctcagtcagaagactttccctgccgacgtatgctccctctaattccaccttgacatttgtttcccagaagtctggaactggcgcgggggctttggaagtagcaagtagcaatacagtagcagcaatgagtgatggaagctgatagaaaatgcagtcactttggttagcggttggcctgcacgagatggcgtgggcatgtcaatctgaggtctctgcctctggtagacaagatttctatgcatgaaatagagtcctgttgcagcctgagaccgaaagtgctggcagggttaaagaaatcagggctgcaaatcaactgggatctgctatattcacaggacgttggagtttggatcttgctcatggctggcgaagtgtttagatccttttggatgtaagtggtccccttctttgtttacatcttttacagaattttccagtcttatttccggggctggcggtggtatttgctcagttagtgagctagaagctgtgaggcctcacccacattcccttttctgggccagcactccaaccccagccgccagcgatcaaggctgcctcttctctgggatgtcatccttggctggcaggagccagtttgctccaggtttttgctgtcctgcccctgcccccatgactgatgcagaggcacagaaggggcccctgtatctccggaggggtgaatctgccagggacacctgctgcgtgggacaggctaagaccagacttccggaaatcctccccggtcagctgcatctccttccaagctttgcttccctactttgccttgcaggtccttccagaagagcactccccatcaacccgcgggcagctgaattcccacctcagactctgctccaagggcgccgtgtctacggaggcgacgctgaggatggcttatcaggttgggtcactcaccccaccacgaggacctgaccttaaattctcggtgcatcctaagtgtgacccagagaccgcctgcgtcagaagcacctagaatgctgtggaagcaccttcaatgcagattcctgggcccaaccctggttccactgaatcggggtcagctggtgggcccaggaattggcattttcaacagcttccaattgtacaccagaatactcaagcttgtgactcccctgctcactgttttcttcatcctttctcacttcctgctgagtacatatgtattttactacttttagagatacttttacaataaaggcagtcttgaaagtgtgtccggaattggtgggttcttggtctcgctgacttcaagaatgaaggcgcggacctgagtgttacagttcttaaaggcggcacgttgggagttgttcgtttctcccggtgggctcgtggtctcgccggcttcagaagtgaagctgcagaccttcgcggtgggtgttacagcccatagaggcaacgagttcggaattgttccttcctcccggtgggctcctggtctcgatagcttacaggaacgaagctgcagaccttagcggtggatgctacagctcataaaggtagtgcagacccaaagaccaagagaacaaaactaccacaacgcagaacagaaccctagcgggttgccgctgctggctcaggtagcctgcttttattcccttatttggccccacccacatcctgctgattggtccattttacagagtgctgattggtccgttttgacagagtgctgattggtgcgtttacaaactttagctagacactgagtgctgattggtgcatttacaatcctttagctagacagaaaagttctccaagtccccatctgacccacaggcccagccggcttcacctctcaaaagcatttaatcaattggattgtgtgtcccaccaaacaagaacaatgtattcatctttgtatcaccacagtctgacactctgcctggcacctaatatgtgctctgtaaactatttatagaatgaataaaacattaaatgcttgcatcatgttgaacaggggatacaaagaagtttaagccactctcatgttcctttaagcagattataattcagatcaggggccgagtgtggtggctcacacctgtagtcctagcactttgggagcccgaggtgggtgggctcaagggttcgagaccagcctgggcaacatgaatacacagctcttgttaaggattttattctttattccaagaacaataggaagccagggaaatgggtcagtcaatgtgatgggcaatgaaaggctggctggaatttgggatgagactgtaggagcactgccagggtgctgcacggctcggctcctgcttggccccaggctcagccctggagccgcctccacctgggctatttcacccgggctggtccgccacctgggaaggctcttccccgatccactgaaggagctgcctgaggtatgaacggcagagcctcccgggagcctgcccacccacactctcctcatgaggtcccctttcattctccatcttagccggagattctttccttgcttatgctgagtacaacctgcaatcattatatggatttgattatttgggtttctttctaataatctccctcatataagctccaggagggaaagaaccataactgccttgcatcccctttgcctgggacagtgactggcacagggtggatgctgaagacgttggggcagtaggaatgagtgacaatgggtcaagtgggtgcctggcgggagtccctctgggagggtgtgagtgatgacgggttgtaggttgactgtggtatagacagcaagaagaggctgaactcaagcagccattgtcaaccttttttatctcaggacctctttttactcttaaaaattagaggatggcctggtgcggtggcttacgcctgtaatcccagcatgttgggaggctgaggcggttggatcacctgaggttgggagttcgagaccagcctgaccaacatgaggcaaccctgtctctactaaaaatacaaaattagccaggcatggtggcacatgcatgcctgtaatcccagctactctggaggctgaggcaggagaattgcttgaacccaggaggcggagtttgcagtgagccgagattgcaccattgcactccagcctgggcaacaggagtgaaattctgtctcaaaaaaaaaaaaaaaaaaattggccaggctcggtggctcacgcctgtaatcccagcactttgggagactgaggcgggcagatcacgaggtcaggagatcgagaccatcctggctaacacagtgaaaccctgtctctactaaaaatacaaaaattagctgggcaaagcctgggcacagtggctcacgcatgtaatcccagcactttgggaggctgaagtgggcagatcatgaagtcaggagatcgagaccatcctggctaacacattgaaaccccatctctactaaaaaaatacaaaaaaactagccaggcatggtggcgggcgcctgtagtcccagctactcgggaggctgaggtaggagaatggcaggaacccaggaggcggagcttgaagtgagccaagatcgcaccactgcactccagcctgggcgacagagtgagactccatctcaaaaaaaaaaaaaaaaaaaaaattagctgggcgtggtggcaggtgcctgtaatcccagccactcaggaggctaaagcaggagaattgcttgaacccgggaggtagaggttgcagtgagccaagattgcaccattgtactccagcctgggtgataagagcaaaactccatctcaaaaacaaacaaacaaaaaaaccaaaaccaaacaaacaaaaaacccgtgtttgccaagagaaaaaaaagtgtagtgagatgaatgacattgttatacatttctgcatgtctttaatgtctgacttattagtagctgttggattcttgtatctgttgctataccataagccatgcagcttctgggaagatctgctatacgtttgtgagagaatgagaatggaaaagacaaataactccttagtattcatgtgataatagctttgatcttttggacttcctgaagggacctcagcaccccttttcccccattcaaggaacccaggtcaaactttaagaactgctggattaatgaggtatttaagagacaagattgacatgcctttgttatattattattgctaatatttatgaatatttatcatatgccaggcatgtttttactcttcacaacaattctatgcagtaggcacctttagtgtcccatttgacacacgagaaactgtgattttaacacatacaatttttcgcaatgcataaatatgtgtttgtgtatacttttttcacaaagaaattggacattgttatttttgcgagaccagaatgactaaattgacaaatgtatagcctttggatggtgcagctgagctcaactccaaacagtgagtctgcaatataaaagtgccctccactactttccagagctcaattacttttgaaatctaactttgatttaaatgtatttttgagccatttcatttttaagagctcatttggagagcttaaaaaattaattaaatcttttgtctttgaagtttaattcttccacttctggcatattctctatggcttatgagaaaaattgccaatcactcgggtaatttgcacctaaaataaaggtgcagaaaagttgaaattagaagcagctagaatattagttccttggtttctcctgccagggctttggaccaaaattcacagaactttcctgtattttcacattttccttttttaggaacttctaggagaaagtggtacttgaaccaagtcctgttgaaggctctactttctcaaggcacctggtcaccaccactgtctctctgctttgaatatgggtggttaagaatgtttatgagttttaaaacatttatagcaacaaatatctatagaaagatctataggatataattttgagaaaaatggccacccttggtgttgactactatcccaatggtactgattagttgtctggttggtctttaatcgtaggggcacacctctctacaccctaagattaaaaagataaagtcattagggtgctcaagttgtgaacatctcattgatgaaggctttggctcaattgtcgatgattatgatgctgttggcctctgctttgccccacagttaaatgcattaaataaacatttctgactatcggtgcaatcatgagggccctcagcttagctgggatgaaatggcttcaaaagtaggtaaaggaactcatgttgcatttgacaaaccctagctcctacctaaaccctaatctaaataagagatttttcactgggtttctagaactgtgctcctggagggcagagatgagcacgttcatttctgtgtcttcagacctgcctgacagacagaaagtgctcagcaaggtggttttatgaacggctttcatgcctgacacggacatgccactgcttccatttacagcaagacgtgccaagttgcagggatttctcctgcagaggtatttgtggtgaggaaggaaccctcatgactgttaagtcaagaaatctacctgctgtgtgctcagccttgagtgtccataggaatgagtatgtggacaggtgagggtctccagctgtcctgcatgttggctgaagctctgttattgttttttgtttttttctgggatggagtctcactctgtctcccaagctggagtgcagtggcgcgatcttggctcactgcaagctccgcctcccgggttcatgccattctcctgcctcagcctcctgagtagctgggactacaagcacttgccatcacgcccggctaattttttgtatttttagtagagatggggtttcaccatgttagccaggatggtctcaatctcctgacctcaagtgatccaccctcggcctcccaaagtgctgggattacaggcatgagccactgcacccagctgttttgttttgttttctgagacagagattcactcttgtttcccaggctggagtgcaatggcatgatcttggctcattgcaacctccacctcccaggtttaagtgattctcctgccttagcctcccaagtagctgggattacaggcatgcaccaccatgcccagctaattttgtatttttagtagagaaggggtttcaccatatcagttaggctggtcttgaactcccggcctcaggtgatctgcccgcctcagcctccaaaagtgattacaggtgtgagccaccatgcccggccttgaagctctgttattgtgcatgagatgtctggcagccttgtcttctaagggagggccgagtagtatggtgggaaaagcataagacatggagggccaggcatggtggctcacacttgtaatcccagcactttgggaggccaaggtgggcagattgcttgaggccaggagtttaagacaagcctggccaacatggtgacaccccgattctactaaaattacaaaaactagtcggggcatggtggcatgcacctgtaatcccagatactcaggaggctgaggcaggagaatcccttgaactcaggaggcggaggctgtagtgagcgagctgagatcaagccactgcactccagcctgggcaacagagtgagactctgtcaaaaaaaaaaaaaaaaaaaaaaaaagcatgagacacggactctgagaatctgcttctatacatttactgtgagctgttatctatcgctgcaaaacaaactccccaacacagtgacttagaactattgaaaaagaccttctctttgaccaaacttgagtcaggctcccctgagtcttcttctcaaagaggctttaaccttgcctgtgaaaaccgcaaaatctcaacagaaacaattctgttcaccctcacactaggagacttgaaaacacactagcttggtttctaacagctcgaggtcatgtccctagcatgacccagctcctcttgagttcctgcctggaaaagctcagggctgccagcagaatttactgtttgagatttgcatggacccaatgactgccttgtctaacaattctctgaaaagggccccccacccactcttagtaagtttctgcttacgtgactccacccgaccccacccaagctcctcctgcttattcctcctccatcctccctcatcctccccttaaaaatgcccagtcactgctgggcgtgatggctcccacctgtaatcccagcactttgggaggccaaggtgggtggatcacaaggtcaggagtttgagaccagcctggcctggccaacatggtgaaaccctgtctctactaaaaatacgaaaattaactgggtgtagtggcacgtgcctgtaatcccagctactcaggaggctgaggcaggagaatcgcttgaacccgggagggggaggttgcagtgagccaagatcctgccactgccctccagcctgggcaacagagggagactctgtttcaaaaaaaaaaaaaatgcccagtcacctctgcatggctcagagttgagctcagcatgcactgatgtctctctcccttactggagtagtctcaataaagtccatcctgctgtctttaataagtgcctggctctatttctttttgacactgcaataaactcttattaactcacacagtttcagtggccaggaattcaggagagccttagctgggtggttctggctcaagatctctcaagatgtggaccagggctgcactcatctgaaggctcgtcttgggctggagggtcggcttccaaggtggcacactcacgtggacggcttggtgctggctgttggtggtaggcctcagtttccaccatgtgggccttgccacaagtctgagtgtccttgtgacgtggcagctggctccccccaagaatgaagagagagcaagctgggggctgcagagtctttaatgacccggccttggaagtcccacatggtcccttttgcagtgtcctgttgatttcagagattctagtctctgtggcagggactccaagggtgtggacacagaggcaggaatcactggaggatatcttggagactggctgcatgactcagcttgtaatccgtgttgtgaccttgggcaggtcactggaattctctgggctggaacaataagggtaggcgaggcctgacctgtgagggccctcctgggcctgactttaccttcttttttttttttttttgagatggagttttgctcttgttgcccaggctggagtgcaatggcatgatctcggctcactgcaacctctgcctcctgggttcaagtgattctcctgcctcagcattccgagtagctgggactacaggtgcgtgccaccacgcctggctaatattttgtattttagcagagatggagtttcactgtgttaggatggtctcgatctcctaatctcatgatctgcctgcctcagcctcccaaagtgctgggattacaggcgtgagccactgcacccggccgactttaccttctattaagcaagagagtgatgtgctgaatgaaagagttaacgtgcctacaaaagcatttctcacagagaggaactcatctgccagggtctggcccagatcctagaattgggctgcttgttttgtgggggaggggggaggggatcgcagcagctgtctgggtttcccgtcatttctcctctcacttccgaggtcagggagataggaggagacatgaacaggtggctcctgacgaggctggctgggatcagccctgatacaaagacaccaaggatttggaaatgaaaatgcaagtgggggagattggcaggctgccctcggaaggagctggtcctagttttgctcctttgaggagttttgcacctgattaatgattctgttcaagatggattaagctgctggaacctttctccatttagcagtgccagctctctcctcctcttaacgctttttttttttctcgtcccagtctcccccacccccagtttgttctcgggacaaaccatcggtctaggatgaactccgttttccactggaaggtctcaagaggctaaaggcaccccacgggcttctccccgaggaagggactgaggacagaggagggccacggttgcaatgaggacagctccggctcaaaagcgtccctggacccttgactctcagcttgtcttgtcttccttaataaatttcagtttgcgggggaggggagagggatagcattaggagatatacctaatgctaaatgacgagttaatgggtgcagcacaccaacatggcacatgtatacatatgtaacaaacctgcacattgtgcacatgtaccctaaaacttaaagtataataataataaaattaaaacaacaccccctgcagaggttacatttcccccttttcttctgtcatcttctccctttccttccagtgtcacatggggagcagcaaagcctcaaaatcatggccttataattttcgtcatcactggaatggattctcagtttcttctccattcttctccttcctgcaagaacattcttctaatatgtattgattagccatttgaaagattgctcttcctgttttttgtttgtttgtttgtttgttgagacagggtctcacttcgtcacccaggctggagtgcagtgccgtgatctcagctcactgcagcctcgacctcccaggttcgagcgatcctcccacctcagacccacaagttggtcttcctagtggacagctgttaaagtgagcttctgattggaccttcgttattttggggtgacggagagcagtaaaaacataggagagcttggtcttcgcctttgattccctccgatcctgctgcagcccctgtttttaacaccactttccccttggctctgcccgctcctccccctgccgtgtcccccccaggctccctcgccacgtttcaagttgttctttattcagctgggatccaaggatctccctccagagaaagcggatcattgccggctccttcgagtcccggagtgccaagtcctgcgcccagcacaatggtcctttatacctcgctgtgtgctctctttcctggccccagctgcccccatgccctgtttttccttactcttttctgcagtattttctttccagttgacttagttattacagtacatggaccggggaggaaagctccggaacctgggcctggcgcatggagtctgagagcaagtgtggctccctggccctgccatgaagctaccaggaggtgatcggtcacattcctacacacagagcctgggctcgctttgctttcatggcaggggacagaggcagggcttgtctcctgatagccagcttccctgtggggtcctggccctgccagcctaggacatttccacaaacagaactgagtactgagtggtgagtgggtgaggccatcatttctcaactgcagcttagcatgaagtgtaataaataagactgacacggccgggcgcggtggctcacgcctgtaaccccagcactttgggaggccgaggcgggcggaacacgaggtcaggagatccagaccatcctggctaacacggtgaaaccctgtctctactaaaaatacaaaaaattagccgggcgtggtggcgagagcctgtagtcccagctactgggtagcctgaggcaggagaatggcgtgaacccgggaggcggagcttgcagtgagccgagattgcgccactgcactccagcctgggcgacagagcgagactcagtctcaaaaataaaataaaataaaaaaaaagaataacacgtttaaaaaagaaaacagctccaattaaagggaaggggttgaggctgggcatggtggctcacatctgtaatcccaacactttgggaggccacagcctgaggattgcttgagcctaggagtttgagaccagtttgggcaacacagtgagacccctgtctctattaaaaaacaataggctgggcgcggtggctcatgcctgtaatgccagcactttgggagaccgaggcagacagatcacctgaggtcaggagttcgagaccagcctggccaacatggtaaaaccccgtttctactaaaaaatacaaaaattagaccggacgcggtggttcatgcctaataatcccagcactttgggaggctgaggcggatggatcacctgaagtcaggagttcgagaccagcctgaccgacatggtgaaatctcgtctctactaaaaatacaaaaaaaattagcggggcgtggtgttgtatgcctgtaatcccagctacttgggaggctgaggtaggagaatcgcttgaaccggggaggcgggggttgcagtgagccaagattgcaccattgcactccagcctaggtgacaagagtgaaaatccatctcaaaaaagcaaaaaacaaaaattagccaggcgtggtgatacgtgactgtagtcccagctacttaggaagctgaggcaggagaatcacttgaacctgggaggcagaggttgctgtgagctgagatcatgccactgcactccagcctgggtgacagagtgggagttcatctcaaagaaaaaaaaaagcacaacaacaatagctgggtacagtggcccacacctgtaatcccagcactttgggagactgaggcaggcagatatttgaagccaggagttagagatcagcctgaccaacatggtgaaaccccatctctaccaaacaaaaaatacaaaaattagctgggtgtggtggtgagcacctgtagccccagctactcaggaggctgaggcagaagaattgcttgaacccaggaggcagaggttgcaaggagccgagattgggccactgcactccagcctaggcaacagagtgatacaccacctcaacaaataaaaaaattaaattaaattaaatttaaaatattttaaaaaccaacaataatgaataataaaataaagagaagtggctgatattggagtagatgaaagtagaggtgccaccatcagggacttggagactttctgtctgtgcgtgggatcgaccagcggcgaggtgttactaccctcccctggctgccaggggagcctggaaggcaagacggatacaggcccctttcaactcagagatttgacttcctccttccctcttgtttacaaggggctaccagaacttccaagagctacaaatggtgatgttgacatgaaacacctgctttcaattttttaaacattttaaattaagctctttaagtttgtaataaaaaaaaactagggtttcggggtagggtgtggtggctcacgcctgtaatcccagcaccgtgggaggctgaggtgggtggatcatgaggtcaagagattgagaccatcctggccaacatggtgaaaccatttctctactaaaaatacaaaaaaaaaaaaaattagctgggcgtggtggcatacacctgtagtcccagctactcgggaggctgaggcaggagaatcacttgaacctgggaggcagaggttgcagtgagccgagatcgcgccactgcactccaacctggcaacagagcaagactccatctcaaaacaaaaacaaaaacaaaaaaaactggtgtttgatttttgaggtcctggatttcaggaagaaaatgaaaaagtctaacatggacaacaaagatcacccagaacaaggaagacaaaattcgtgaccacgttggcttccctctcatttacgtactcgtgaatatttgcagggtacatcgcctgaggactaggagcaggtgactgatttgtattgcagctgaaactgtggaaagagggtggagggtgaccgagggcacgtttttaggtgtgatgctgttgatgaaaactcatctagaatgttggacacaactgagaaaacaccatcagctggatgtggtggctcatgcccgtaatcccagcactttgggaggctgaggcaggaggatcacctgaggtcaggagtttgagaccagcctgaccaacatggtgaatgaacccctgtctctactaaaaatacaaaattagtcaggtgtggtggcgggtgcctgtaatcccagctactcagaaggctgaggcaggagaatcgcttgaacccagagaggccgaggttgcagtgagccaagattgtgccactgcactctagtctgggcaacagagagagattccatctcaaaaaaaaaaaaaaagggaaagaaaagaaaaaaagaaagaaagaaaaaacaccatcaccactaccaccgccctgggacgacaaaggcgattgtaatccaggtttaggagatggcccttgtcaggctgcctgggcggctgtaggtgcggtggataccggtaagcactgtaccatactgcatccaaaaatatttaactacgtctctaccagtcgttaaatagatgctgctccatctctccccacgccccaaaatctgcctcttctggcccctctctagggatctcctggagcttcttaaaatccagctgctaaagggctaagtctggcatagctggggtccaggaccttgtttcagagttaaagctggtatccgttgttagacattttgaatattgcccctgcttataccgatgactgtaatatgtgttggcagagacatctggaaggagctctgccatggcaatgcttgaaggctgatccactgaatatgagagtgagttctggtacatgggagggggggccatggcatgaaacccgttcctagacatcgaaatttgatttattaacattggcagcagatacgggccatcttgccaacaaactttctgaaattgaaatcgcatgaaactttcctagttcctgctagtgccacatacgcccttttctttctaaggcagcaaattcacttaaaaataattaagaaaagattgatgggattttggaattgtaatgaaaaatatgatctcattagtaagtcatgagtcagggccaggcactctgtcagatgtacgcacttctgcataattagaagctgatgcaaggagaactaataatggcatgaattaaaaaattaaaatggtttccctttatacttttttggctgtgctgaaattcttccttttgcaaagattcagaaagagatctctttcaaaagaccctatcacatgcaactgagttgatgaaaaagaaaatggcggtgaaagaatggaaagggaggctgggggtgtggctcatgcctgtaatcccagcacttcggaggccaaggtgggtggatcacctgaggtcaggagttcgagaccagcctgaccaatatgatgaaaccctgtctactactaaaaatacaaaaattagccaggcgtggtggtgtgagcctttagttccagctacttaggaggctgagacaggagaatcgcttgaacccggggaaggcggaggttgcagtgagccgtgatcgcgccattgcactccattttggatgacagagtgagattccatctcaaaaaaaaaaaaagaattgaaagggctaaatggatttccactaaatccgccgggaattctcatttaggccaccagtccagggtgagaactgctgtaattcacttgtcttcaagagggtaaatacatacctgagggggataggttttgaaaagagccactagacgaatcatgtaaatgtcacataatctctgacttaaccacagaatgaataaaacagttaccctgcagaagcagcattcatgcttttcgaggctgtagtattcatgcttttcgaggctgcagtgagtttggagtgagacacagcgggcagcacccttatctctgccgctttgagtggggtgaccctgactgactgaattagtttaagccgtgatttactcatttgtaaaatgagaataaggaaactagcctctcaggtttagtacaagaatgaaatcacataacattcagagggcaggcattcattaaaaattatttatcccttcatgaaaaatattgcagaggaaacaaacaaacaaataaaatgtatctccccccccaccttttttttttgagacagagtctcactctatcgcccaggctggagtgcagtggcgtgatctgggctcaccgcaacctccgcctcccagattcaagcgattctcctgcctcagccttctgagtagctgggattacaggtgcgcgtcaccacctctggctaatttttgtatttttagtagagacggggtttcaccatgttggtcaggctggtctcaaactcctgaccttgtgatctgcccgcctcggcctcccagagtgctgggattacaggcgtgagcaaccatgccccgccttttttttttttttttgggacggagtctcgctctgtggcccaggctggagtgcagtggtgtgatctcagctcactgcaacctctgcctcccaggctcaagcgatcctcccacctcagcctcccatgtagctgagaccatagttgtgcaccaccatgcctggctaattttttgtatttatggtagagatggggttttgccatgttggccaggttggtcttgaactcctgagctcaagctatcctcctgctttggtctcccagagtgctgggattacaggcgtgagccagtgtgccctgccatcctttcccttttctttaggtaccttactttgttgacatttgaaagtagaacattggccgggcacggtggctcatgcctgtaatcccaagagcaaaactccgtctaaaaagaaagaaagtagaacatttttcccttatttttttttttttagatggaatcttgctctgtcgcccaggctggagtgcagtgcctggatcttggctcaccgcaacctctgcctcccgggttcaagtgattctcccacctcagcctcccgagtacctggaattacaggtgcgcatcaccacacccagctactttttgtatttttagtagagacggggtttcaccatgttggtcaggctggtctcgaactcctaacctgaagtgatcccctggcctcagcctcccaaagtgctgggattacaggcatgagccaccgcacctggcgaaggtcttgaccattaagtgaggagattaaacttcctttggttgggagtcatggaagattttggagcaggtaaatgacagagattcattttgaagtagtgcctacaaaatgacatggaggcagaagaaacagtgggaagactgtagtccaggaaagaaatcatggaggcctgaatgggatgatggtaatggacatagcagggaaaagggagataagagacgtagttgaagcagacgctatgggacctgggaactgagaaacacccaggccctcataagctccccagagagatggaatctgatgctaatgtcactcttccagacattatcccaaaagagttggaacctgctgggaacctgatgctaggccaggtaattccactgcatttcccatccctgtcctctccaccacccagaatgtgcaccctctctctgtctcctgctggtgtcgcttcccttcccttgacgtgcttcccgtcaggacccctcctctctttccacagagtcttctggctaaaacccatcacctcccatgtgccaagcactataccaggggctctgcacacatgatctgatgcaaaacctttttttaggccgggcgcggtggctcacgcctgtaatcccagtactttgggaggccgaggcgggtggatcacctgaggccaggagtttgagaccagcctggctcacgtggtgagacccccatctctactaagaatacaaaagttagccgggcatgggggcgggcgcctctaatcccagctacttgggaggctgaggcaggagaatcgcttgaatccgggaggcagaggttgcagtgagtcgagatcacgtgagactttgtctcaaaaaaaaaaataagtaaataaaaatataaaacctgtttttagtggaaggctccctccagagctgtgctgcatggcggtggtttgttgatagaaactccctgcacaaggacttcaaatcagtatcctgttagttccttgttacacaccagctttttcaaatcatcatgtcaccttggtgtaaaaccccacatgctctttttttttttttgagacggagtcttgctctgtcgcccagactggagtgcagtggcgcgatctcggctcactgcaagctctgcctcctgggttcacgccattctcctgcctcagcctcccaagtagctgggactacaggtgcccgccaccacgcccggctaatttttttgtatttttagtagagacggggtttcactgtgttagccaggatggtctcgatctcctgacctcatgatctgcccgcctcggcctcccaaagtgctgggattacaggcgtgagccaccacgcttggccaaatcccacacactcttgcacagtttttctttctgtttcattacttctcacctctcctccacgccgtctacccaagtcctggtcacggccatatttattgaaggttctggcatgggtcgtggcagtctttcattctagcccacgtccccatcatcctcagtgactgcagtgcccatttgaataatcggcataaaactctagtctcaagcttccttcacctccagctctgagtcttcacctcctttctccttgctccacctgttccaatggtacacctaagccttgccattgctaggactacagatccgtatcagaaatacattcttggctgggtgcagaggcttgcacctgtgatcctagcactttgggaggtcgaggcattgggatgcttgagctcaggaggttgagacactgtctctacaaaaaaatacataaattggccaagactggtggctcacacctgtaatcccagcactttgggaggccgaggagggcggatcacctgaggtcgggagttcaagaccagcctgactgacatggagaaaccctgtctctactaaaaatacaaaattagccaagcatgcctgtaatcccagctactcgggagtctgagacaggagaatcgcttgaactcgggaggtggaggttgcaacgagccgacatcatgccattgcactccagtctgggcaacaagagcaaaaccccatctcaaaaaaaaaaaaaaaaaaatacaaaaattagcggggcatggtggcatgagcccgtagtcccagctacttgggaggctgaggcaggaggttggcttgaacccaggaggtgaaggttgctgtgagttgggatcgcgccactgcacgagccagttttgagccagaccctgtctccaaacaacaacaacaaccaaaaaaaagaaaaaaagaaaaaacctctcaaactccaccttctcatttttcagttccttcaggctaccaccacctccacaaccacgctgaatagaagtggtgagagtgggcatctttcctcattcctaatttcaaagggaaaaatgttcacatttctatctattttctttttcttttttttttttttgagacggagatgcactctgtcgcccaggctggagtgcattgggtgatctcgactcactgcaacctctgccccccaggttcaggcgattttcctgcctcggcctccccagtagctgagattactgacgcccaccaccacgcctagctaatttttgtatttttcatagagacggggttttgccatgttggccaggctagtctcgaactcctggcctcaggtgatccaaccaccttggcctcccaaagtactgggattacaggcgtgagccaccatgcccagccattattattattatagttactattattggagacacagtttcgctcttgtcacccaggctggaggcaatggtgtaatctcggctcactgcaacctctccctcctgtgttcaagcgatcctcctgcctcaaaatcctgagtagctgggattacaggcatgcttcaccatgcccggctaattttcttttctttttttttttgaggcggagatgcactctgtcgcccagcctggaatgcagtggcgccatctcagctcactgcaagctccgcctctcgggttcacgccattctcctgcctcagcctcccgagtagctgggactacaggcgcccgccaccacgcccggctaattttttgtatttttagtagagacagggtttgaccatattagccaggatggtctctatttcctgaactcgtgatccacctgcctcggcctcccaaagtgctgggattacaggcgtgagccatcatgcccggcgaagtcaggctaatttttgtattattagtagagatggagtttcaccatgttagccaggctggtctcaaactcctgacctcacgtgatccactgacatcagcctcccaaagtgctgggattacaggcatgagccactgtgcctggttatagttctttttttctttttttagactgagtttctctctgtcacccaggctggagtgcagtggcacgatctcagctcactacaacctccgcctcccaggttcaagcaattcttatatttcaagcgattcccagcttcccgagtagctgggattacaggcgcccatgaccatgcccagctaattttggtatttttagtagagacagcgtttcgccatgttggccaggctggtctcgagctcctgacctcaggtgatccacctgcctcggcctcccaaagtgctgggattacaggcgtgagccactgagcctggcccatatttctctattcagtatatttgcagaggtcaattttattaaatattttaatgcatctattgagatggtaacataattttctcctttattttgctaatgtgctgaattacatttttttagtaaaccaatttaacattcatagcatacacgtaaattggtcacgctgcattagttttcttatacatttgtagaactggtttgcaatatgttatttggcatttctgcatctatgtttatgaatgatattggcctgtaattaaattttttttaagtaatatccttgacaggttttgctacaaagttatgatagcctcataaaatgtactttgtttcacttctctgggagagtttgtttgagattggttttagttcttccttacacgttgataaaatttatagaaaaagccatctggtcttagagttttctttgggggaaggttttatattacggatttaacctcttttatagttataaaataattcaggttttctgtgtctttttgtgtccattttgtttttagtaaaaattttcaatctttacataaagtcatttaaagtgtatacctatttttttttttgaatatctgcaagatctgtagtgatgtctcttttttcattccaaacatatttttttggttcctcttctccttttttcttgagcagtttcatcagagatttatcaatttaatttttttttttttgagatggagtcttgctctgtcacccaagctggagtgcagtggtgcgatctcagctctctgcaaactatgcttcctgggttcaagggattctcctgcctcaccctcctgagtagctgggattacaagtgcacgccacaacacctgtgtgccaccacacctggctaatttttgtatttttatttatttatttatttttgagatggagtcttgctctgtcgctcaggctggagtgcactggcgcaatctcggctcactgcaacctccgactcccgggttcaagcgattctcctgcctcagcctcctgagtagctgggattaccagcgcgtgccaccatgcgcagctaatttttttgtatttttagtagagacagggttttaccatgttggtcaggctggttttgaactcttgacctcgtgatctgcccgcttcaggctcccaaagtgttgggattacaagcatgagccaccgcacccagcctagtattttttttaaaagaaccaatttttggccaggtgcagtggctcacacctgcaatcccagcactttgggaggccaaggtgggaagatcacttgaacccaggagtttgagaccagcctgggcaacacagtgagacttcttctctacaaaaaatagaaaaattagcttaacatggtgatgcgagcctgtaactccagcttcttggcaggctaagatgggaagatcagttgagcctgggaacctgggatgttgagtcggccatgagctgtgattgtgccacctcactccagcctaggtaacacagtgaaacactatctcagaaaaaaaagaaccaattttttgctttactgattttctctattttctgtctgtttttatatataattatatatatatatataatcatcaatatatgcttttattgactgggcgtggtgactcatgcctctaatcccagcactttgggaagccgaggcgggtggatcacctgaggtcaggagttcaagaccagcctggccaacatggagacaccttgtctctactaaaaatacaaaaattagccaggtgtggtggtgggcacctgtaatcccagctacttgggaggctgaggcagaagaatcgcttgaaactgggaggtggaggttgcagtgagtggagacagggccactgcactccagcctgaacaacagagtgagactccacctcaaaaaaaaaaaaaaaaatatatatatatgcttttatgtatattgttattattatagagatagagtctcgctctgtcatgcaggctgaagtgctgtggcacaatcatggctcatttcagcctcaacccgccgggctgaatcgattctcctttctcagcctctcgagtagcagggaccacaggtgccacacctggctaatttttttatttttggtagggacagggtttccctatgttgccaaagctagtctcaaattcctgggctcaagctgtcctcccacctcagcctcccaaagtgttggaattacagacatgagccaccatacctggccattagctatattattttcttccttctactttcatttagtgttttctgctactcctgttctaacttttgagatagatgcttaactcattaactttcagtctttcttctttattaatatagcattttctttttttatttttaagccagtcaaattttaatatagtactttaggctatagattcttcccctaaataatgctttagcctacatctcaccagctttatatgtaatattttaattgtcattcagtttaaaatattttatgatttcagccgggtggtggctcacgcctgtaatcccagcactttgggaggccgagtcggggggaatcacttgaggccaggagatcgagaccatcctggccaacatgatgaaaccccgcctctactaaaaatacaaaacttagccgggcatggtggcgggcgcctgtagtcccagctactcaggaggctgaggcaggagaatcgcctgaacctggggaaggcggaggttgcagtcagccgaaattgtgccactgcactccagcctggcgacagagtgagactccgtctcaaaaaaattaaaaaaaagagtcatttgtctcctggaagagctcaggaaatgttagaatctctcctttgcttctctccctcttgctgtgctgttcctattacattgtaattatttgtttacatgtctgttccaccttcccaagtgagttatgtgagggaaggcttcatgtcacgtcatctggtatcctcagaagatagcaacgtgcctggcacatagtgggtgaataaatggactctagtcctgtttcataaatagtaattgaatgaatctgaaaaaaatcaatctctataggcaaaaactcaatgccatatatctatggaatttttgctttaattatggttaatgatgctttaactgatccttgattggcccaaatgattagaaaacagtcataaacagtggctcatggctgtaatcccagcactctgggtggctgaaagaggtggatcacttgaggtcaggagtttgaggccagcctggccaacgtggtgaaaccctgtatctactaaaaatgcaaaaattagccaggtgtggaggtgggcacctgtaattctaggtactcgggaggctgaggcagaattgcttgaacccaggaggcagaggttgcagtgagccaagatcgtgccactgtactccagcctgggtgacaacacgataccctgtctcaaaaaggaaaagacgaaagaaagaaagggaaagaaagaagaagaaagaaagaaaatattcatagaggtaagcctgagcttacccttagcaaaactgcgaagctggtgacatctgtctttgttttttgtttttgtttttttggttttttttttttttttttttgagagggagtctcactctgtcacccagggtggagtgcaggggggagatcttggcaacctccacctcccgggttcaaccaattctcctgcctcagcctcctgagtagctgggaatacaggcatccgccaccacacctggctagttttttaatttttagtagacacagggtttcaccaggttgaccaggttggtctcgaactcctcacctcaggtgactcgccacctttggcctcccaaagtgttgggattacaggcatgagccaccatgcccagccgtctgtctttgtttttgaacctgcctggcggcatcctactcttgctttctgtggccgtcactaatccaggtaccttttccatcctcagcttgccctcaaggctggaaaacacaacatgtggattcagctttaaggctgaagagcatccaacactctggtcagtcatgtgtcctggatggagatgggagctctgaatgcttctttccttaatttagcaaaataagaggacagaaagaaatatttatcaggattacaaccgccactatttattgagtcagacactgttaatcatttacgtgcattgttgcatttttgcactcttgacaacatttctatgagagagatactacgttgttcccattgctgaggttaggaagtaaaggctgactagatatgcccacagttcggcatctaacaaatggcaaagctggaattcaaacttaccttctctggtttaaagtgggtgcttttttttttttttttttttttttgagacagagtcttgctctgtcacctagactggagtgcaatggcacaatctcggctcactgcaacctccgcctcctgggttcaagtgattctcctgcctcagcctcccgagtagctgatgggtccggaattggtgggttcttggtctcactgacttcaagaatgaagccgccaaccctcgcggtgggtgttacagttcttaaaggcggcgtaaccggaatttgttccttctgatgttcagatgtgttccgaatttcttccttctggtgggtttgtggtctcactggctcaggagtgaagctgcagaccttcgcagtgagtgttacagctcatacagacagtgtgaacccaaagagtgagcagcagcaggattttttgcaaagagtgaaagaacaaagtttccacggtgtggaaactgacccgagcgggttgccactgctggctcgggcagcctgcttttagtctcttatctggccccacccacatcctgctgattggtagagcccagtggtctgttttgacagggcgctgattggtgcgtttacaatccttgagccagatacaaaggttctccaccttcccaccagattagctggatacagagttaagacacacaggttctccaaggccccaccagagtagctacatacagagtgtcgactggtgcattcacaaaccctgagctagacatagggtgctgattggtgtgtttacaatccctgggctagacataaaggttctccacgtccccaccagactcaggagcccagcggcttcaccccgtggatcccgcaccggggctgcaggtggagctgcccgccagtcctgcgccgcgcgcccgcgctcctcagcccttgggtggtcgatgggactgggcgccgtggagcagggggcggtgctcatcgaggaggctccggccgcacgggagcccatggagggggtgggaggctcaggcacggcgggctgcaggtcccgaggcctgccccgcgggaaggcagctaaggcccggtgagaaatcgagcgcagcgccggtgggctggcactgctaggggacccagtacaccctccgcagccgctgacccgggtgctaagcccctcataagccggccggctgcgccgccaagcccacacccacccggaactccagctggcccgcaagcgctgggcgcagccccggttcccacttgcgcctctccctccacaccttcctgcaagctgagggaaccggctccggccttggccagcccagaaaggggctcccacagtgcagcggtgggctgaagggctcctcaagttccaccaaagtgggagcccagacagaggaggcgccgagagcgagcgagggctgtgaggactgccagcacgctgtcacctctcactgagactacaggcgcacgccaccacgccccgctaatttttgtattcttagtagagacaaggtttcactatgttggcctggctggtcttgaactcccgacctcaggtgatccgcctgccttggcctcccaaagtgctgggattacaggcgtgagccaccgcaccccactaaagcaggtgcttttaaccactattccaaattcccaaatgtacagaccacggcattgtctgaactggaaggcatggtcaaaactttagtctgaattattaaaatcttattgaagaatttaataactgaggaaaataagcagagaaaatatttctggacaaagggaccaatttgttgcttctaaaattatatcgcatgatattttgtttactaatatttgaatttggcaattgtgaggctaagaaaatggaaatggggctgggagctgtggctcatgcctgtaatcccagcactttgggaggcagaggtgagcagaccacaagttcaggagttcgagaccagcctggccaacatagtgaaaccccgtctctactaaaaatgcaaaaattacccgagcatggtggcgtgcacttgtagtaccagctactcaggaggcagaagcaggacaatcgcttgaacccgggaggcagaagttgtagtgagctgagatcatgccacggcactccagcctgggcaacagagtgagactctgtctcaaaaaacaaacaaacaaacaaagaaaatggaaatggttaagttaggggagctgtagaccaagtcagtactccagtgatcagacgaagtagccctcctcagtttttttttttttttttttttgagatggagtctcactctgttgcctaggctggaatgcagtggcatgatctcagctcactgcaacctctgcctcccgggttcaagtgattctcctgcctcagcttcccaagtagctgggattacaggtgcccgccaccacgcccagctaatttttgtgtttttagtagagatggggtttcaccatgctggccaggctgttctcgaactcctgagctcagacaatctgcccgcctcggcctcccaaagtgctgggattacaggcatgagccaccgcgcccggctcaccatgttggtttctaagatttcctgtttgtctcttgttccttgtgtaagagtaggtactatcataaatcctgcccttagggcaaacgaccttgaggtcatcatacttcagttcctgcatagcccttctgaaccacccctcccctatgctacataagcccggagtaggggagtggcagcctgcggatccaccacctccattagcttttgtttataagtctccattaggtgattccggctaagaaacaggatttgtcagcctctttctttggcctctcagcttcctgggactctggggcaggtttggatagtcctgccaaccgcagaacactcatcaaggtgggagtggaaactgctgcagagaagaatcccatttgtgtttgtgctcttacccagggctgggatgtgaggcccctcctcagtttttaacaggacaaggccagaaatgtatcaagaatcattcattcttctgcagcaaaacaaacctcccactgctccctggagaacaagacagtttcagaagggaaaagataagagttcttctgagctttcaaagaacttaatagggaggcaaaaaagaaaacaaacaaacagaaaaacaatgctttcataaagtgaaggaaaaaaatctctggctaatctgattgttaaagtgattgtaccgaaataaaaaatctctcaaacaggccgggcacggtggctcacgcctgtaatcccagcaccttgggaggccgaggcgggtggatcacgaggtcaggagatcgagaccatcctggctaatacggtgaaaccccgtctccattaaaaatacaaaaaattacccgggcgtgttggtgggcgcctgtagtccgttgtagtcccagctactcgtgaggctgagacagaagaatggcgtgaacccgggagacggagcttgcagtgaactgagatcgtgccactgcactccagcctgggcgacagagcgagactccgtctcgaacaacagcaaaaaatccctcaaacatttgatcattcctactcttggaactaataatattaaatatatatttgtaacatgattgttcatattttaattataggttaacaatggtgcgttcatacggtgtttgcttgcttgaagaagttgctttataattaatatagtattagcatataatttgaaacaactggctgggtgcggtggctcacgcctgtcatcccagaactttgggaggccgaggcggacagatcacctgaggtcaggagttcgagaccacctggtcaacatggtgaaaccccgtctccactaaaaatacgaaaattagccgggtgtggaggtgcatgcctgtagtcccagctcctcgggaggctgggcaacaagagcgaaactccatctcaaaaacaaaacaaaacaaaacaaaattttaaaaaaagcatgaaagatgtaattttttaaataaataaaattaaaaataattgcctgttgctcaggctggagtgcagtggtgcaatctccactcactgcaaccttcgcctctatggcaagaacttcggaagggcacaagtcatattgcataatgagcgtgacaagcctcagcttgtttatgccaatatttctgacactcacttgaccatggaggtttctgtgaaggccacagccaggtacccagtaggccattagtgagcatctgtggtgaacaaatgaaccttgcaggccacacactgggagatgctgctgtaaggcagaggatggtctacgataatattacatacaaaatgcaggagatactcttttgaataggtggcgtcttactactccttcaagccacatacaaggttagcatccccaccaagtcagccctactttgtataggctcagtttcactgaatggaaactccttgagggaagggattaatgaatgcttactggatgaataaattaacaaacgaatatcagaattgcttgaacctgggaggtggaggttgcagtgagccaagatcactccagcctgggggacaagagcgagactttgtctgaaaaaaacaaaaaaaaagtaaaaaaaaaagtaagcatgttgggcagtagggagtgggaactgaaatgaaaagctatgtgtgctcatattggccaacatcttaagtagaattagaatagtacggttccaccaaagctgtcttctcagacacttgatttaaggtagtctcttccttgagatggcatccatttcaggacagaattagaatattagaggaactaaagttaattattaaagccttaaaaagtatggggctggggctcaccctaaccagtggcatggtctttatttttttatttaattaattaatttatttttttgagacagagtcttgccctgttccccaggagatggagtgcagtgacacgatctccgttcactgcaacctccgcctcccgggttcaagagattctcctgcctcagcctcctgggtagctgggattacaggcacgcaccaccacgcccggctaatttttgcattttttttagtagagacaaggtttcgccatgttggccaggttagtctcgaactcctgacctcaggtgattcacccgccttggcctcccaaagtgctgggattacaggcgtgaaccaccacacccagcctatttttttattttttatgttggccagactggtctcaaactcctgacctcagggaatccacctgccttggcctcccaaagtgttgggattacaggcgtgagccaccacaccgggctggcatggtctttattaacaatgaggacaggtggggcatggtggctcggcctgtaatcccagcactttgggaggacaaggtgggcggattgcatgagactaggagtttgagaccaacttgagcaacatggtgaaaccccatctctacaaaaaaaacaaaaaaaacaaaaattatccaggcgtggtggcgtgcacctgtagttctagctacttgggaggctgaggtgagaggatcttgagcccaagaagtcgaagttgcagtgaacagagatcgtgccactgcactccagcctggatgacagagcgagaccctgtctcaaaaaatgtatatataacaacgacgctgttatttctgtatgggagatgtctctgtccccagtctgctagaagagaactggccaaaatatattaattgaatgaaataggaattacgggaatttggaaatggagctgaagaaaatgcagccagtgctaatccaaggctaagtattctccacggggaagatgactacgtgggggtgtgagttccacgaagacagagcagccgaggaggaaggaaggaccaaggccaggcctggatgccactgcagggagggtggccttttcattttctgtgagtgtttctcattagtcaaaaaatgtgcctgggtttgtatcctcttgtttaccagatgaagggttgccctggggggcctctgggctctgggctacagtaatgattgcggtgaagaggatgacaatttacatttctatggttctccctagaggactcagcctggggaggagtgttctgactacattttagtgttagacgatcagattaaaatgaaggtcagagaatctcacagaatgcgaaagggaagaccggctggagaagtgggtggggaggatgttagggtggattgtttctaaccctctcttccctcactgactcttttgcaggtcagcactccgcccaccaactgcctagttctctgctcactgcaacctccgcctcccgggttcaagcaattctcctgcctcagcctcccaagtagctgtgactacaggcgcccgccgccatgcccggctaatttttttttttttttttttttgtattgtagtagaggcagggtttcaccgtgttgtccggctaatttttgtgtgtgtgtgtgtgtgtgtgttgtagtagaggcagggtttcaccgtgttgcccaggctggtctcaaactcttgagcccaggcaatccgcttgccaccgcctctcaaagtcctgggattacaggcgtgagccaccgcgcctggccttggcttcttagtttgtggtcatgtttttttcaggcaaacgctgaagtcgtggcacttcaacatcagtgggaagggagcgctttgtaacaacagggaggaaaactgacttgtaaatacaagagctcaggaaccccatgcggccacatttaaataccagcgggagaagtaggggtgttcccttctgcttggacctccgctgcctcagctggagagtctgtttgtccagcggacagaagagggagaagtacacagagctgatacagcttctgatcgcgcaaatgaagagccataaatatcttagccgggcgtggtggcgcgggcccgtactcccagctcctgcggaggctgaggcacaagaatcgcttgaacccaggaggcggaggttgcagtgagctcagattgcgccactgcactccagcctgggtgatagagcgagactgtctaaaaaaaaaaaaaaaaaaaaaaaaaagaagaagaagaagagccagaaatatcaacatagaaggaatttagaacaaagcaagtcacaaaaactatagcagtcatctaacccagccttccacggggtgcagctctctctgctgcctgtgcaacccacgcttgaaggcctttattcgggaggaatttaggagctacctcccaggcagctcgagtatgtgataaaaagttccttcttagattaggccaaaatttacttcctggtaacttttaccctttggagtaataacagcgaatccattcctttttccttctacaccattgccttcctactagttgaagacagtccctagtccctgtaaacactctcttctcagaggcagggaagccagaggcaggaaacagtggctcctgagtcggggcactccctcccagcatcccaacaggacaagcatcctggcctctacgtcctgaggtcgcgttgctggccaaagtctttaggatacgcaaatataaaacaaatggtgataataacatttggacaaaatagtatcgtttcttctctattcttgtcaaacctctcaagtaaaggttatattgtgaaaaattctaaacaacgaaggcaaggcaaagatttgcaaagtacatggtaaaggtatactctccttaatgaagtggtgttcaaaagttgttttaagactttttttttttacaggtgcagtggctcacacctgtaatcccagtacttcgggaggctgagatggaaggatcacttgagcctggatgttcaaggctgcaatgagctgtggctgcactgctgcactccagcctgggagacagaatgagactctgtcttgaataataataataataataataataattgttttaagattttttattttttgagacggagtttcactcttgttgcccaggctgcagtgcaatggcacgatctcagctcaccgcaacctccacctcctggattcaagtgattctcctgcctcagcctcccgagtagctaggattagagatatgtgcctccacgcctggctaattttgtatttttagtagagacgagctttctccatgttggtcaggctggtctcggactcccgacctcaggtgatccactcgcctcggcctcccaaaatgctgggattacaggcgtgagccaccgtgcctggcctaagatttttttttttttgagacagagtcttgctctgttgcccaggctggactgcagtggcatgatctcggctcactgcaacctccgcctcccgggttcaagcgattctcctgcctcagcctcctgagtagctgggattacaggcgcatgccatcacgccggctaattttttgtatttttagtagagacggggtttcacctgttggctaggctggtctcgaactcctgacctcatgatccgccctcctcggcctctcaaagtgctgggattacaggcatgagccactgcatctggccaatattttttttttaagagcagttttaggttcacagcaaaattgacaggaagcaccagagatttcccatatatccctgtccccacacactcacagtctctcccattgtcaaccagagagtgacacatttcttacgatttttttttttttttgagacggagtcttgctctgtcgcccaggctggagtacagaggtgccatctcgactcactgcaagctccgcctcccaggttcacgccattctcctgcctcagcctcccgagtagctgggactacaggtgcctgccaccacgcccggctaatttttggtatttttagtagagacggggtttcaccatgttagccaggatggtctcgatctcctgaccttgtgatccgccctcctcggcctcccaaagtgctgggattacaggcgtgacccaccgcacctggctatttcttacgattaatgagcccaccctgacacatcatcacccaagtctacagtttacgttcgtgttcactctaggtgttttactaaatttaatggacaaataagagctaatacttctgaagtgcttactgcaagccaagcactgttcttcgtgttttgcatgtgctatgaagtaatttaatttttacaatgactctatgcattacctgatgtccccactttacagacagggacactgtttgagattggttacttgtttgagatcgaacagctgatgaatgaggcagaagtggatggagctcaggtggtctggtccagtctgttcctgtgctcttgaccaccctgctgtgctgtctctatggacggggacacagaaagagaagtcgacaagggaaaaggagaaatctcaccagcagctagggacatttagggtgaggcactgagacactgtctgttttgaaccttcaactgaaaaaaatctcatgtttgtgaagtcacagggaaaaggccattttctgtgctgccgaaggcgttccatcatgaaggacgggctaacaccaggcaccaacaaaatgtgtagctcaggagtgctatttataagaccttggcggcgcatggtggctcacgcctgtaatcccagcacttcaggaggctgaggtgggcggatcacttgaggtcaggcattcgagaccagcctggtcaacatggtgaaaccccgtgtctactaaaaatacaaaaattagccgggcatggtggcaggcatctataatcccagctacttgggaggctgaggcacgagaatcctttcaactcagcaggtggagcttgcagtgagctgagatcatgccactgcattccagcctgggtgacagtgcgagactcagtctcaacaacaacaaccaaaaaccttatcctgaggggctaagtaagaatcacacaaaagtttagttattggctgggcacagtgggtcatgcctgtaatgccaacactttgggaggctgaggtgggcagatcacctgaggtcggtagttcgagaccagcctggctaacatggtgaaaccctgtctctactgaaaatacaaaaattagctgggtgtagtggcaggtgcctgtaatcccagctactggggaggctgaggcggaagaatcacttgaacccgggaggcggaggttgcagtgagcagagattgcgccattgcactccagcctggggaaataagagggaaactccatcttaaaaaaaaaaaaattagttacaaacaatctcagagttggtatggtagagtggctatgatagagaaaagttaagaaaaaaaaacaaacttttggctgggcgtggtggctcacgcctgtaatcccagcactttgggaggccgacgcaggtagatcacaaggtcaggagtttgacaccagcctggcgaaagagaccagcatggtgaaaccccatctctactaaaaatacaaacgttggccgggcatggtggtggatgcctgtgatcccagctactcgggaggctgaggcaggaggattgcttgaacccaggaggcataggttgcagtgagctgagatcgtgccattattctccagcctgggcaacagagcaagactctgactcaaaaaaaaaaaaaaaaaaaagaaaaagaaaaagaaaaaaccaaactttcaacacaaggagattgattacatgaagcaagacacattctttttgttgctgttgctgttgttgttttgagatggagtcttgctctgtcgcccaggctggactgcagtggcgtgatcacggctcactgcaacctctgcctcctgggctcaagcgatcctcctgcctcagcctcccttgcagctgggattacaggcatgcgccaccacgcctggctaatttttgtatttttagtagagacggggtttcaccatgttggccaggctggtctcgaactcccgacctcaagtgatccgcccacctcagtctcccaaagtgctgggactacaggcgtgagccaccacgcctggccttaggacacattcttaaagtgggtgccaggcagtcaacagaaaaacttgctaacatttttaatttttaatttttatttttattttcagacagagtcttgctctgttgcccaggctggagtgcagtgatgcgagcttggctcaactgcaacctctgcctcccgggttcaactgattctcctgcctcagcctccagagtagctgggactacaggcacacaccaccacgcctggctactaaagttgctaacattttgccagacaagaatttcaaaagacactgggtgtggtgtctcacacctgtaatcccagcactttgggaggccagggtgggaggattgcttgaggaaggagttcgccaccagcccagacaacaaagggagaccccatctctacaaaataaataaataaaaagaatttcaaaagaatttttcacacatggcaatgtgtttgtgatatgtgggaaaaaaacaggtttcaatgtaagaataaatcactattttctcattgttctgctgagaaatgatcgtaaagatttatgccaggccgggcacggtggctcatgcctgtaatgccagcactttgggaggccgaggcgggcagatcacctgaggttgggagttcgagaccagcctgtccaacatgctgaaaccccgtctctactaaaaatacaaaaattagccgggagtggtggaacacgcctgtattcccagctactcgggaggctgaggcaggagaatcgtttgaacctggtaggtggaggtgcaatgagccacaggccactacactccagcctgggtgacagtgcgagattccatctcaaaaaaaaaaaaaaaaaaaaaaaagacatatgccaagttgtaattagtgattatttctcaatgaagtaatggtgatttgattttcttctttgagtctattgtattttttttccaaattcaacacaaaaaaggtagtaataggaaagtaaacagtatttttaattaaaaatagtaagcagaacatttcaaaataaagcacctattgggactctactgtgagaaaaatagcccatctcccatggcacctcattgtcaaagtccacaggggtctctgaaaaatggtgattatacttttgtctcactattaacacacagatcccatcagaatgcagtcattttcttgtaaaggagaaagttcttggtaaggaagccacaagtagaaatagttttccattttccttaaatttgtccttgaaagttttatacctgagtatggactctctcaagcagctttcctaaggaggtcaaaatgctgatgctgaagtttgtctctgttgccccctaggaccaccacctttatggggaccgagagtctccagggaaattctactttgtaatgagatgttttcttcctttatctgatgactcctaagctggacaaaatctgttctgtaaataaaggtggcgaatgcctcagtcggtactcctgggtcctgtttgaagcagaagaatgtgagaggctcttagtgatgcactttgggccagggtgtgtcttgtgcattggtggctcagcccggacagccggcaccccacatcagggagggctgatggcagctttctggacagcttgaggctacaggatacacatcgggtctgtgctagacctgctggtagaagaagtgctctttcacggaatggttctctttcttgaacttgcctatggcaagggcagaaaagaaacatggggtctgggcttttcaatcaggttgtatatctcttcactgatcttccttcccactctccccacccagatggcccaggcctgctcattcctcatttccaccgcgagcatcacctcgcacagtcctcaacaaccccagcctctgcccccactaacccaccctgccagctctccctcgaagacgtcctcctccatgttcatgctgacgttgcctttcttgtttgtgtttcatccacctgtaaaatacaagtttcaaggccaactcagaggacaaagaaactgcttcaggcccggtgctgtggctcacacctgtaatcccagcactttgggaggccaaggtgggtggatcacttgagttcgggagttcgagaccagcctgaccaacgtggagaaaccccgtctctattaaaaatacaaaattagccaggcgtggtggcgcatgcctgtaatcccagctactcagaaggctgaggcaggagaatcgcttgaacctgggaggtggaggtcgtggtgagccgaggtcatgccattgcgctccagcatgggcaacaagagcaaaactctgtctcagaaaaagaaaaaaaaaattagctgggtgtggtggcgcctgcctgtagtcccagctactcaggaagctgaggcaggagaatcgtttgaacctgggaggcggaggtttcagtgagctgagatggcaccactgcactccagcctggacgacagagcaagactctgtctcaaaaaaagaaaagaaaagaaaactgcttaaggttcatctttgagctggagagttagtctttaataaatgccgtcctgcagcagagatgcactgtggacacatagcaggaggtgaggaaagcaagcttgccaatggatgagtaattgaggaaaaccggggaataactaggagactaatcaaagtctgagaacatcatttaaaatgaccaagtcaaccaggcatggtggctcatgccgcccagagtttggaaggccaagacgggaggattgcttgaggccaggcgttttgagaccagcctgggcaacatcgtgagaccctacccctacagaacataaataaataaataaataagtataaaaataccacgtcaatgtgttttgcaacttacacagtgtttgtctcattgtggcaggatcctgtgctaggttgtgtatttagcagacaaaggcccaagataagaaataagcttggcagataggtatggaagaaggtcaggtggctgacaaagttcaaggtagaacagaggactcagtgcagtgggtggcagggaaaactgatgatatcagtctggaattaccagattagacttttttttttttttttttgagacgggatctcactgtgttgtcaaggctggtcttgaactactgagctcaagcaatcctcctgtctcagcctcctgagtagctgggacttcaggggcacaccaccgtgcagctttcagcccagattttcactgaagaagtgcaagtacagaaatgcaaattttagggccagcgcagtggctaacgcctgtaatcctagcactttgggaggccgaggcgggtggaacacttgaggtcaggagttcaagaccagcttggccaacatggtgaaaccttgtctctactaaaaatataaaaaagctgggcgtggtggcaggcacctgtaatcccagctactcaggagcctgaggcaggagaatcacttgaacctgggaggtggagtttgcagtgagccaaagtcgtgccactgcactccagcctgggcaacagcaagactctgtctcaaaaaaataaaataaaaaaataaaaaatgcagagatagtagaaaacccagggggtgagcaagaggaagaagggagcattaggaaaagtgtcaggtgacataaggcagccttgccctggctgctcccgttccctgacttaagcatggctggcaactttgcttcctgcccacctcttccatgaagccctctgtgaccctttggtttgaaatagctgcccaatcactctgtccatcaggttatttcatatctcagccaagcacttatcactccctgttattttcttgtttgtcagtttactccctgtctctctcaataaggatgtcagtgctctgcaagcagagaccttgggtggcagaatctagaactgcctgcacacagtacatgctcagtaagcattgctgaatgtgtctacctctcccattcatctttgaatttaactaccaagcaacatggctggatataaagaaggaaacccataagttactggcacatagtttgtctcatgcacattttgacattgaatatattaacagtgacaagtccttccctcatatacctgtcgaatgaatgtatcttgcactgttctctgacaaactgtcctattcatgctggccttgtcattttatcattctcaacacatccccacacttgcctgacttctctgcctttacacacagtgtcgtcaacactgaggcactattccttttccttctatctatggacagccaacccatgctttagattccagttcaactctcttttctttttcttttcttttttttttttttttgaaacagagaaacagagtcttgctgttgttgcccaggctggagtgcaatggcacgatcttggctcaccacaacctctgcctcccaggttcaagcaattctcctgcctcagcctcccgagtagctgggattacaggtgcacgccaccacacccagctaatttttgttttttagtagagactgggtttcacctgttggtcaggctggtcttgaacttccgacctcgtgatctgctcgcctcggcctcccaaagcgctgggattatgcttcatcatcctattgggaacagactccacagctgggtgcaggagtggtctgtggctcctgtctgtcggatgacagcttcacgttacccccagcacagaggtggcactgggataggcacacgactctgcaaagccaatcgggtaccaggagaattttgctgagggcgttgggattatggcaggtgctcctccctgtggtgcttgatttgagagcattaaggcctggagctaagtagccactgatatggtttggctctgtgtccccaccgaaatctcctgttgaattgtaattgccagcacgggagaacgggcctggtgggaggtgattggatattggggatggacgtcccccttgctattctcctgatagtgagggagttctcgcgagatctggttgtttaaaaacgtgtagccgccccccaccccccacccccccgcgccccgccccacgctcttcctccttgtgcagcttccctttcgccttctgccatgattggaagcctcctgaggcctgtgcagccacgtgagtcaattaaacctcttttctttataaattacccagtcccaggtagttctttatggcactctgagaacggactaatacagccaccttgtgagcctaagggagaagcgtgctggggacgtgaccctcccccaacaaactcctgcctcttgtggagggaatggcatgtttgaaggaaaaggtctggcatttaggggaaatgcaagaagttgtgtgtatgaatgtagagggaagaggcaggtgggaatagggtggggagaggctctatatgaaggaagagaggtaggcagggtcctgatcatataggactttgaggaagccaaaggaccttgtccctttcttcccctgagcttacattctgggagctccaggttagacaggaccacacgaggcctttgagctcctgggggaatacagatatgttcttgggtgtttgaaagagttctatgagaattttgcaattttgtattttagttttgaaaaacaatgtgacttttacttttttttaatttaaaattttatttttatttatttggcaaataaacattgtgtgtgtgtgtatgtatatatttatttattgagacagggccttgctctgttgcccaggctggagtgcagtggcgccatctcggctcattgcagcttcaacctcctgggctcaagtgatgctcccacttgaaccacaggtgtgcaccaccatgcacagctaactcttttattttttgtagagatggagtcttgctatgttgcccgggctggtctcaaactcctggacttaagagatcctcccaccttggcctcccaaagtgctgggatcacaggtgtgagccaccaaccctggcctaaaaattgtatatttttattgtgtataccatgatgggtttttttgtttgtttgttttgtgagacaggttttgctctgttgcccagggtggggtgcagtggtgcgatctcggcttactgcaacctcctcctcttgggttcaagcaattcttgtgcctcagcctcccaagtgctgggactacaagcgcatgccaccatgcctggctaatttttttttttttttggagacaaagtctcactctgtcgcccaggctggagtgcagtgatgcgatcttggttcactgcaatctctgcctcctgggttgaagcaattctcctgcctcagccttccgagtagctgggattacaggtgcacaccaccatgcccggctaatttttgtatttttaatagagacggggtttcaccatgttggtcaggctggtcctgaactgctgacctcgggcaatccgcctgcctcggcctcctgaattgctgggattacaggcgtgagccactgcgcctggccaatttttgtattttttaagtagagacagggttttgccaggtttgccaggctggtcttgaactcctgacctcaaacgatccgcccacattggcctcccaaagtgctgggattataggcatgagccactgtgcctggcccaccatgattctttgaatagaatggctacatcaagcaaactgacatatgcattacctcctgtacttacttttgtgtgtgtgtgtacaatacattttcttttttctgtgagatggagtctcgctctgttgcccagggtggagtgcagggtgcaatgtcggctcactgcaacctctgcctcccaggttcaagcaattctctgcctcagcctcccacgtagtgggattacatgcgtgcaccaccatgcccggctaatttttgtatttttagtagagatgaggtttcagcatcttggtcaggctggtcttgaactcctgacctcacgatccacctgtaaatccaggttggattacaggcgggagccaccgcctccggcccacaatatattttctaaactagctggtgatcacccatgactgagtgtccgcataccatatcaggcttgcgcatgtgtcctggtactagttgttcatttgccctcttccctctctggtctccaccacccacctttctccacccggcagaaactgatcagtatggacggaatccacaggctcccttgccttttgctttctggtgtgaggagccctggcgggaggggacgacagcaagagtgaggcctctcccagcgagcctggccctggctgtctgtgcccctagaccaaaggtcacatgtctcacggtggcttctctccttgactccctcctcctgtttgggggcccctcaccgtcctgtgtcctgtaagcctagcagctcctctgccatcagcccctggtttccgcaccacctcagcacatgccaggcgtctccttgtaagtcaaccctcccccgagtacccaaggctcggtgagcccgccaccttctgttgggatcctgactgatacaggcatcgggtaggatgacttttacttttccgcattaattacaagagagagatagttggactgaatctgggaaagattcattcaaattgaatgaaggctcgatgacatcaagagccttgtgcctcgcgccgttcacataaggatactgagcagtttgaatggagaaaagcagtagaaaaaccgacttcgcacagcagttgccggtggctgccaggcagtggcaatctgtactgtgttcttgtatggagagtgatttcatttcagcaaaacaacatcaactgttacattcagttagagctgttaatttgacttctatttgccttatacttgtgtctgtatattatttgcaaattgtttggttttattatagtataaaattcataatcttttttttttttttttttttttgagacggagtctcgctctgtggcccaggctggagtgcagtggcacaatctcggctcactgcaagctctgcctcctgggttcaggccattctcctgcctcagcctcccaagtaactgggactacaggcgcccgccaccacgcccggctaattttttgtatttttagtagagacggggtttcactgtgttagccaggatggtctcgatctcctgacctcatgatccgcctgcctctgcctcccaaactgctgggattacaggcgtgagccaccgcgcctggccaaaattcacaatcttaagcgtttatacctaggttcatgtttattactttttttgtgtgtgtgtgaggtagagtttcactcgttgcccaggctggagtgcagtggcgcgatctcagctcactgcaacctccgcctcctgggttcaagtgtttctcctgcctcagcctcctgagtagctgggattgcaggcatgcgccaccacgcccagctaattttgtatttttagtagagatggggtttcaccatgttggtcagattgatctcgaactcctgacctctggtaatccacccgcctcagcctcccaaagtgctgggattacatgtgtgagccaccacaccttgcccatgtttattacttgtaaatggtactatgataaaataatttgattttttaagaatggctccatacatccctcaacttgagaacactggtctagtccaacatttcctctgctgcggaaatgcttctgatacaccagaggctccatatccatttgtcaaaaaggtttgacattaaactaaagttaaacatttccaatcatgcatcctgattttgcccactatagtgaccctcatgaaaagtccaagctcttttctatggaacagttttccatcgctgatatcccataatagcactcccatctctccattcctgtttctcaaatgcttaccccaatcccgggtctcaatgcaaacgccctcctccgtgaaggagtccttcacgttcttcccctgaccagaagcggcctcccctcactggaactttcacagtgaatcatagcccactgtgcgtgccggttgccggtgcatagcttcctttctcctgttagtttttgcttttggaaagcaggatttgttattcattcatttgtactcactgtagccctgaccagtgtctaacatatatagatgtttaataaatattgaattaaaggaatcagtgaaaagtgtaagaatatattacacacacacacaaatgaaaaatagaaaagttctgcataaatgtataatacacatttgcctctttttttttttttttgagatggagtcttgttctgtcgcccaggctggagtgcagtggtgtgatcttggctcactgcaacctctgcctcccaggttcaagtgattctcctgcctcagcctcctgagtagctgggactataggtgcctgccaccatgcccggctaatttctgtatttttagtagagatggggtttcgccatattggccagactgatcttgaactcctgacctccagtgatctgccttggcctcccaaagtgctgggatgacaggcgtgagcccccgcacccggcctgcctggtatttttagtattcgttctctctgaaccaggagcccgcttcaggctgccgtctagcagcaccactgaatgctgtgtgttaacctgcagacttcaacttctctgtgctagaggccaccttctgtttgtaaagcgccagaatttccttgtccctcacaccacttctctaaatggagtctaacatcagcctctttttttttttttttttttgcaagacagagtttcgctcttgttgcccaggctggagtgcaatggcgcaatctcggctctctgcaacctctgcctccctggttcaagtgattcttctgcctcagcctcccgagtagctgagactacaggcgtgcgccaccacgcccggctagtttttgtatttttagtagagatggggtttcaccatgttgaccaggatggtctcgaactcctgaccttgtgatctgcctgcctcggactcccaaggtgttgggattacaggcatgaatcactgcgtctagctgagttcaaacaattctcctgcctcagcctcccgagtagctgggactacaggtgcccgccaccacacccggctaatttctgtatttttttttttttagtagagatggaggtttcaccatattggccaggctggtctcaaactcctgacctcaagtgatccacctgtctcagcctcccaaagtgctgggattacaggcataagccaccacaccctgcccaaaactcggaactttaaaagaatagatagggagtcactgattatttattttatagcagatttttaaaaatacctggtttcccaagttatttgaatcctcattgattttaaggctggatagtccttaaacattatctataatactttaacacttaatgttttacaagtgaagaaataggccatctgtttgttcagtttattccgggactcttcaaccctgtgggtagaaaatcacagagcaaagcagatgaatgtcattgccaagcaatggatgtcattgctaagttgaaggccggcttcatttgggggcctcagcattacagagtgattgagcaaccttttaattaccctctggtcaccacccctaccttcaaatgctatcccgacctgtctcactccctcttccttttttattccctttcccaaactcattcttcacagccaaacttgtcctcattcaacaaatatttattaagtgccttctgtgtcccagatatagctccagatgccgtggggagagcagcaccttaggccaaggttcctgatctcaagaagcttctttttttttttttttttgagacagggtcttactttgtcacccaagctggattgcagtggtaggaacatggctcactgcagcttcgacctcctggactcaagtgatccttctgttgcagccttccatgtgggaccacaggcccacgccatcatgcctggctgagtttttgattttttgtagaggggggtctcactttgttgcccaggctgatctcaaactactggcctcaagtgatcctcttgcctcagcctcccaaagtgctgggattacaggcgtgagccaccatgacctgccagaagcttctagtcttgtcggggcccggggaagccaggcaacacataaacaggcaaactcacacattttttttcaaacacatttttaaaagtgatggtgaaaggtaattaaaaatagactggtgcaatggcacatgactataatgccagcgctttgggaggcccaggtggtaggatcactggaggccaggagttcaagaccagcctgggcaacatggtgaaatccccatctctacaactctacacacacacatacacacacaattatccaggcatggtggggtatgcctgtagtcccagttacttgggagactgaggcaggaggactgctgaagcccagaggtcgcggctgcagtgagctatgattgcaccactgcactccagcctaagtgacagagcaagaccctgtctttttttttttttttttttagatggagtcttgctctgtcacccaagctgagtgcaatggcatgatcttggttcactgcaaactctgcctcccgagtagctgggattacaggcgtgcccggctaatttttgtatttttagtagagatgaggtttcacaatgttggccaggctggtctcgaactcctgacctcaggtgatctgcccgccttggcctgtcaaagtgctgggattacaggtgtgagccaccaggcccagcctacctgtctttaaaaaaaaaaaaaaaaaaaaaaaagagtgatgtgatacagtgactattttacattaagtgatccttaaaggtttctaggaggggagatgtctaatctgagttctggaggaacaaaaagttcagcttttcaaagttcagaagactatcctgggcagtggcgcaagtgaaaaagtagcaacaattatgtacggaaaagtagacaggtggcaggtcatgttgagcttttcaattcaggggatcaagtttagatattatcccaagtgaggctggaaaccatttgaatagtttaagtggagttgtggcaaatttttatgtgtactttaaaatgggggcccccaaccccagggccacatgccagcactggtctgtggcctgttaggaaccaggctgcacagcaggaggtgagtggcaggtgagggaagctgagctccacctctgtccaatcagtggcggcattagattctcataggagctcgggccctattgtgaatttcatatgtgagggagctaggttgcgtgctgcttgtgagaatctaatgcctggtgatctgtccctgtctcccatcacccccagatgggaccatctagttggaagaaaacaagctcaggactcccactgattatggtgagtatgtaataatacaactaaagtacataataaatgtaatgtgtttgaatcatgccgaaatcatcccgttgccccccatggaaaaattgtcttccatgaaaccagtccctggtgccaaaaagtttggggactgctggctgggtgcgatggctcacgcctgtaatcccagcacttttggaggctgaggcgggtggatcacctgaggtcaggagttcgagactagcctggccaacatggtgaaaccctgtctctactaaaaatacaaaaattagccgggtgtggtcatgggcacctgtaatcccagctactcgggaggctgaggcaggagaatcacttgaatctgtgaggcagaggttgcagtgagccaaggtcatgccactgcactccagcctgggtgacagagcaagactctgtctcaaaaaaggaaaacaaaaaacaaaacaaaacaaaaaaacatttaaaattaccaagctagcagatagactaaatgaaaggttgagcagggttaaaagtgaattgatgacctagaagattttattgacgtattctctcaggctatagcataaaataagaacagatggacactattacatggaaggtaagcatcatggacgtaatcctttaaaaggaataccagagaggatggagtagggagaagtaatgacataaagatcacagaatttcctagaacatattaagaatctcactgagtcctgagaagaataaaaataagcaaaaaaaactccacacctaaatagggggtagttaagaataaagagaaaatcctaaaagctgtcagagaaaatctggcagattacctaccaaagcatgagagtgagactgacatcagccacggggcctgtaagaagataatttagtggcgccatcaaagtgctgagaaaaatatctttgatcttagaattttattctcaatctcccagtcaatattaagagtaaaataaagacattttggatcttctaagagtaagacacattaggacctacaaactctctctgaaggaatgaataaaggacattctccaagaagagaaatgaaccttggaagatataatggattgcaagaaatcaatgtgtgcaaagaaattagcaggcttggtgtggtggctcacgcctgtaatctcggcactttgggaggccaaggtgggtggattgtttgagctcaggagttcaagaccagcctgggcaacttagactcgccatttctatgaaaaaaaaaaaaaaaaaaaggcatagggccaggtatggtggctcacgcctgtaatcccaacacattgggaggccaaggtgggtagatcacctgaggagttcgagaccagcctggccaacatggtgaaaccctgtctccactaaaaatacaaaaattagctaggcgtgttggcacatgcctgtaatcccagctacttgggaggctgaggcaagagaattgcttgaacccgggaggcggaagttgcagtgagccaagatcgcgccattgcactccagcctgggcgacaagagtgagactgtgtcaaaaaaaaaaaaaaaaagacattaggccgggtgtggtggctcacacctgcaatcccagcactttgggaggctgaggcaggtagatcacctgaggttagaagctcaagatcagccaggccaacatggtgaaatcacgtctctacaaaaatagaaaaattagccaggcgtgatggtggtgggcacctgtaatcccagctactcaggaggctgagtcaggagaatcgcttgaacccttgaggctgaggttgcagtgagctgagatcaggccactgcactccagcctgggcaacagagcaatactccagtgtcaaaaaaaaaaaaaaaaaaaaaggacattagcaaaagttatttgtctaagtaaatatggattgtgaattgttttgacattttaaaattataatctgtagctagaaggaaacagggacttagaacaaaagtagctctctcagagccaaagcttttaaccacttgtttttcggttttttgcttgtttgtttttgtttttttgagagcctcattctgttacccaggctggagtgcaatgatgcgatctcggctcactgcaacctccacctcacgggctcaagtcgatcctcccacctccacttcccaagcaaccagaactacaggtgtgtgccaccatgcccggcgacctttgtatttttagtagaggcttggtttcaccatgttgcccaggctggtctcgaactcctgagctcaagtgatctgcccacctcgggctcccaaagtgcttggattacaggcgtgagccgtggtgccagaccttaaccacttgttttgtagaactggttcctcagtgtctagcacagggcctagcacaaaccaagtgctttgcaaccacttgccgaaagaaggaatgaacggaccgatgaacggtgctatcagcatgcagcgtttccagaatattgccattttcacagaggagtgagatttgccacctctgtgagtccactgaggtccctgtagccatgagcggggacacgggcagccaggagtgctgtgctgcagactcttctagaaacaagtttggattgtgctccttccaagggcttctgggaaaaatgcctctctgctggcagctctgcccttccgcctaaggccaagaaccctctgaacaaatagcagcttagtgagagggcaggaggggacagccacatgtctggagagcatacacttcctgttcactgagtgccacgtgggacttttttctacttattccagagccggtctagattcttgagcaaacaaatagaccacccctgtgtgcaagcccacttctcgacctgtgggagaaaccccagtaatgagtgaaaagtctacgttgcaatatttcctgaccccgtttaattctgacactccaagcctgagctttcgcaaatacatagtgacttagaaactagaggatgctcttaaatgccatttattccagatgcagagacgcgtttcaatgcaaggcacaaaaaatgaagttactcagctttttctaatgttggggtgaaatatggccgcagggagggcaaactccactcattatttcccagggagaaatcatgatattttagaaagggtggggagaagtcttgaacaccacaactaatatctaacacaacaattgagtttccagaaaagttcaaaaccaagggcaagacaaataggagatgtgacttggcttggacacagactgccagtgtgaacggccatggcacctacctttcgggagagaactcccttttctaatctattgagaccattgagactccatctttaaggttctttctagtcctaaagttgtacaatttgccatattttggctgcaataatttcctagtctcctctggccatttctattcatttactcacttttaattaaatgagtgttacctgaattcacccttgtaggaattgtatatagttgcattgctacttttccaaccacattcctgcatcaaccagccaccagtgctctcaattcctgcacagccaccaaacagccaacaaatatttatcaagttcctcacatgagccaatcgatgttggacagtaaagaaagcaaacagaccctgcatccaaggaacttgtatttcactgggggaaaacaaactaaatgtgtaaacacatacatacgtagaataattccaggtattagtaaacactaggaagatgtggatggtgaaaacagccacggtgacgaaccagaggaaaaatcttctaagcatagcaatggcaaccacacaagtcccgagacaggaaacagcctggcacctctgaggaaggaggggactgcaaagtggctggggcacagtacatgagggagaaagtgtagggagaaggggtgagtgccctgatcatgcgggcctttgaattttattctgaggactttggtctaagtgtaatggtaccactgcatggtcttaaggcggggacttgatgtgagctgacatatttccgaaagatcactctgtctgctgtgtagaggggtgggctggagaacagggggactatgcagtcaccttaagaaaagttcttggctgcctgggctaatgttagcattggagagggtgagaagtgatttgggacacacagcatgcaaaggctgctgagggcagctgcagaaactcacggggttgctgtcattctccactaaattctcggtaatgctggcatgttttctcctgtcgttgctcaggacactctcagcacattctcccttaaagccttctaccctgcctcttccctcttccctccagacgttagcttgcagcttctgtagagtaaaaggatgccacccacctgcgggatcgcgctccacttcgtgccccacgcatacatgtctgggaaccccgattccatgttttcaggctccgaggaagtccctgggaggcttctctctaacccccaccccaggtccttctgctgacatcctctgagccgctgctcctccaacaggccttctcttccacacgcgccacttcctgaactctgttgattccttcaccgcgtcttaggaacttgcccaagtctctcccaaatccaaaaaccaactgccacttcctgcacgtcctgccctcccttcgttccctcctagctgtctccacgccgttgcctctcattcactccttggttggtcctcgctgcagccattcctctaaatcctcagctgcaaccttctaataaatggacacacatgacttttcctctcctcttctttcagctccccggcgaggtagccccctcgcccaaagaagggctgcgctcactttggggcccctgtgcacctctggcttgcctggagccagctggctgccactctcaagctctgcccacttcacctgcgccgctgttcccaggatcctgggctggcttcttgatattctcacttggtggggtttttgtgagtaatgttctctgggatcagggcttcagctaccaggtcaccaatgactcagaccccacctcaggtctacctaaatggctccctctcctctcctctagtctcctcctttttgcatggctaccgtttcattcaagccttcctgttttcttccctggactaccgtggtagccaccacgttgatcacactgtctacaatttttttttttttttgagatggagcctcattttgacgccaggctggagtgcagtggcacgatcttggctcactgcaacctcctcctcccgggttcaagtgattctcctgcctcagcctcctgagtagctgggactacaggtgtgcaccaccacgcccagctaatttttgtatttttagtagagacggggtttcactatgttgggcaggctggtctcgaactcctgaccttgtgatctgcccgcctcggcctcccaaagtgctgggattccaggtgtgagtcaccgtgcctgtttttttttttttttttttttttttttggacagagtttctctcttgtcgcccaggctggagtgcaatggcacacactcggctcacagcaacctccgcttcccgggttcaggcaattctcccgtctcagcctccccagtaggggattacaggcatgcgccaccatgccaagctaatttttgtatttttagtagagacagggtttcaccatgttggccaggctagtctcgaactcctgacctcaggtgattcacccgccttggcctcccaaaatgctgggattacaggcgtgagccacctcgcctggcctacagttgttaatccttccaattcatcctcttgaagccactagagtaatctttttaacagtgaaatgccatgccatttcactttttatatccttcagactgggtttagtagctcacgcctgtaatctcagcaccctgggaggctgaggcaggaggattgcttgagccaaggagtttgagaccaacctggcaacaaagtgagatcctgtctctaacaaaaaacaaaaagcaaacaaaaaaaaacttagccaggcttggtggctcacacgtgtggtcccagctactctggagactgagctgggaggatcccttgacccctggaggtcgaggctgcagtgagatgtgattgtgccactgcacaagagcctgggggacagagcaggaccctgtctcaacacgaaaccaaaaacatccttgaatgtctccttccgcacctttagagcagttgtttttcttttttgagtttgtttcactcttgtcacccaggctggagtgcaatggcacgctctcggttcactgcaacctctgcctcttcctaggttctgaagtttcttagc

SEQ ID NO: 127 - DNA, 5919 bp, Homo sapiens
ccactgatgaaaaacctctactcctgtatggattttatattactggttgaatcgctgtttgttgtattattttgtattacatttaacatccatgaaaaacgtacatggctgcttatgggctgcggccactcaggcggcacacaaacctggcttgatgcagagggccttatgactcagggtgcctaaagctccagcagaactgctaactcagatgtgaaaatgccagtgtaatgtggttgcattacctgaagaaatcacttcagttatcctcatggtggcattttttttttttttttttttttttttgagacggagtctcgctctgtcgcccaggctggagtgcagtggcgggatctcggctcactgcaagctccgcctcccgggttcacgccattctcctgcctcagtctcccaagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggcccatggtggcattttaactgaagctgctgaaagacaggagcttaaaatgagtttataaaagcaaagtacaacagttttggacatgtctggggagatgacttggctggggctgactgtgactactgggggtgcctttatctgaagtaattatataaataagattaaaagcaacccagagaggtactgatgataagtgattccctgggccctctcaaggcctaatgaaaaggttagggtgagaaaggtagtctggggagaagaattagtgatgcaatgtgatactgaataagaaaactgagttgttgttttactctttagaatttacttaaaatggatctacctgctgtctctacaatctccttagaatcacccaacataagctcaaatcttaacataagcccttcccaattccttcttaatgacacaccccatagtttctgtgccgtgttctctttcttgctgcagcaaactaaataaacctaacttgaaaaaatatataaaaatcaaatcaaatgggtctaaatagttattacaaaaggaatttaaaattatttattgtatttattcacaaatatggtgtctcagtccattttctgttgtttagaatagaatacctgaacttgagtaatttatttataaaaagaatttatttcttatagttatggaggttgagaagtccagggtggaggggtgcatctggtgagagccttcttgctggtggagaccctctgaagagtcctgaggcagtggagggcatttcatggtgagggggctgagcatgctaatatgctaactcagccctttcttcctcttcttataaagttaccagttctcctatgatcaccaattaacccattaatccatgaatgagttaatccatttatgagggcaggggtgataattcaattacctctcaaaggcctcacttctcaatactgccacacttgggattaagtttcaacacaagttttggaggagacaaatattcaaaccatagcatatggcatactcatttattattactagtttaagtggaaatcattttataaatggtaaggattctgtctcaaattcatttttgatagtttatattccaaagtgacctcaatgattagtcattactatcaaaatcctggcatcaattagtactttacagtactgagaccaagatcatctcccagaagctttcataagacatgactcagtaccacagaaatcatgttgtggccttaagaaatggttctattattctatcaagtgattctggttctctctgccttgtactgcaagatcctggacctgttgcattctgtttcaaatttctacgaatcttaaaaaaaaatgtaggaaaggcctccatgaggacattcacaggtaggatgtggttcttgccacacctggctttgaggttgatcacttctgtagtcaccaccacaccaagctgctgaggctgggatggtctccctccctttcctgacggaaaatactttttcgtgaaaagactttcacttttctaagtataccaagacaatttctagactggaggtattacgtgtcccagtataagccttcagagagccagtacttgccaagttagggtgaacaatgttttctaaatctctttctaaattactgtatttcctttgtgtagtttcttataaaaattcccttggaaaaactctaaccttgcttagctatcagccactcctgaactatggaagcagtgctggagagaaggaaggagatgctcccaagtaggatttccctcttaatctctggctcctattttatccaggatgatcatctagaaggagggtctctgctcaaatgtcgcttcatcagagaggcctttctaccactctatataataagatcctatccccaccattctgtttaaagtagcatggcccttttatcaaatgaaattttacattgagttccaatatataaaacagacgaaaacacagctactctgtctgaagcaggagcagtcacagcctacaaggcctctaactcagccttatttctacttctcaccttccctctagcccccttattctgttttgtttttattttttccccatagcacttatttgtttagtatctgcaatggaagaatagattgctacacagctattctggagcacttatagaaagcaatgcaaagagcagttgaggccagttgaagatgtgagggagtagagaagtgtattcaaagcacgtatgagagcaaagtcaccttagcagcaatataggcgattctgctacgagatcccaccagtaactgagcagttatataggaaatgatgatgaggatcagtggtctctgggctgtgtaccttggggtcccacagaaaggcctcaagggctgcctgaagataaaagggctactttaaaaaggcatgaaaaccctgatgcagatgtcagggatttaaagtctgaagattttataagaatctctgaaaaagaagcaagaacaaaatactgaagatcttcatttagtaggacaaataacagaagttcccacagtaaggaggagatgagagggggagatttgaggcctcttgcataaatcagctgagatgtgtgtggtgagcagagggcccccacaccttccaacatgaactgaatcctgccccctcaccatgtggtcttaaggactgaagctcccatgatgctccctggagctgcttcttcacgggcatgagctggctacttggcaattcctcagtgatttctgaaggtgctagcttctctgcaatcatgtccttccttcgtccaaaaaagatctaaaaacaggaataattgaggctgaagaacaccatcaggttgggacttgaggataaaataacagagaagaaactatgcaaaaagtatcatggacacaggaaaagggagggaaaaagtagagccaccttctatttgctgggacacccattagtactttcacccctatacatccagttgtgctgagtgggaatacagtttgagagctctactcccaatgatgtgccagtgctcttgactcagcctgggggttcatctccacaggcatccttcttacctgctttggtccatcaagctctctctccacatcctccagcatagtcacagtttcctctccattctctggatgatgcttctgcacccaggcctgaagctcttttgggaggatggccaggaactgctccagcaccagcagctccaggatctgctccttggtgtgcacttccggcctcagccagagatgacaaagttcccagagccggctcagagcctcatggggcccaggtgaatcctggtagccaaactgcctgaattgctggcggaaggtctctgggctgtagctgctgctccagtggaggctagagtctggatcacaggtctgctcttcctcttccatcttctctgtcagaatcccattacactcctctgaagtttgtgttaggagtgatgatgactttcccaattttgcagacattttgacagacaaatagctcagtactgttaggctttaatcctcaaggaggtgaagctgtcctgatggacactccttaaatatgattaaagaaacaagtggaaagaagacaaaagacaaatgcttcttagaacaaaacaactaagattagaaacataagactgtataggaactactgaccttagtcttaacagaaaccatgcttttatttatttatttatttttgagatggagtcttgctctgttgcccaggctggagtgcaatggtgtgatctcggctcactgcaacctctgcctcctgggttcaagtgattctcatgcttcagcgtcctaagtagctgggactacaggtacccgccaccacgcctggctaatttttgtattttcagtagagacagggtttcaccacgttggccaggctagtctcgaactcctgacctcaggtgatccacccgccttggcctcctgaggtgctgggattacaggcttgagccaccacgccaggcccagaaaccatgcttttgaagaatacttctttaagagaaccaaacagctaagactcattaattcatatgcataagtgattcacaattcattctgaaaaccatgcccacaaggctactgaatattacaataagagatcagccaggattgcatagaagctcccagataatggaaataagggaagcctgagaaatgctctaactctggagccagttcaaagagccaatcggtatttagtgtgctgcaaagagctcaaagaaatagtctcatgagggaagcacttttgtgtgacttttttcagcttttactgttaaaacattacttcgacattaaaggaaccattaaaaaaaaaataaaccaatcagctgggcactgtgcttatgcctgaaatcccagcactttgggaagccgaggtgggagatgggaggatcacctgagcccaggagtttgggaccagcctgtgcaacataatgggaccccatctctaccccaccaaaaaaaaaaaaaaaagaaaaaacaacaaaaaaggcaatcacgttccttcatctgaatgtatttctatttttttccatatccatattacttacttaactattttaaaatacttaggttgtttctaatttcactattataattaatgctgggaggcacatctttatgaatatactgtttttctcctttcaaagtatttctttcaagcatgtcccaaggcctctgcttgttgaggatcaaaggagaagagcaaattctgtcttgctatgtattatcaaaatattgcacaaagactgtatcaattcacaataccatcacaatcatagtgacttgtgagggcaacgatttcttcaagtattattagctcgttagcaacaaagttggggggggacggcactttcctttgtatcattttactgttaagtatcaccagtaactaatctcattttgttgttgttgttgttttgttttgtttgagacagagtctggccctgttgcccaggctggagtacaatggcgggatcttggctcactgcaacctctgccttctgggttcaagcgattctcctgcctcagcctcccaagtagctgggattgcagacgtgtaccaccacgcccggctaatttttataattttagtagagacggggtttcaccatgttggccaggctggtctcgaactcctgacctcaggtgatccctctgcctcggcctcccaaaatgctgggagtacaggcgtgaggctctgcacccggtctaatcatattttttaaattgggcaggaggtatatgatagtgtttgtacaacttcagcaaatgatgactactttaaaaatcttacgtgcgcctccgtcttcc

SEQ ID NO: 128 - DNA, 1884 bp, Homo sapiens
agaacgggagtgcattctcaggcacctaaatcttacaggctcagtgcctgcacagggagacgggtccgcagcccagggtcccgggcagctttcgggcttgggggtggattgacacacagcccgatggtattcacacccattccttcactgtcgcgcccggtcctgggggacggcatggcaccagccaacgtcacgggttgggtgtgagttcatggtagattctcacacgccagcctcacaagaggcactgccgagaccaggcttgctgccgcctactgtatggccggccctgtgggcacagctgtcctccacccgcctcccaaggcaccatcgggcccagaatgtgcccgatgagtcacgggcctgggtctccccagcatgggcgcagcaggggggctgagtccgcctgagccccggtgcccagctcagggtctggcacagagcagatgctagtgaatgaacgtcgggctggatgaatgaacgaatgactaatgcccgctccctcaaaccacaggctacaccgtctgagcctgggggagggcagagcccacgggaccccagaagaggcctccgcagctgaggctttgcgtcccagggtcgatgggggagggggcggggcggccagcagccggcgcggcacggggctcccctccttcccgagaaggaatctgggtctctggactgagctggtgacgggggctggggcggggggttgtggcgtcctggatggagagagctgcaggagcagggggcgcgtcccggtttgcgttggggtgtgggacgaagcggcggccgcgggacatccccttcggtggcgaagcccgggtctgcccggggcctccgcggggtgcagagggctcccaacggcgggactggcccggggcgccgcagacctggccctttccggcggggccgtggagaaggggacgcggtgtcccccgaggtgaccgggggcgcaggaaggacggggggcgcgcggagccccctctccacgcgcgggaggtccagccccgctaccgccccctacgccctcccgggacctccgcccacctgcgcgaggggttcacctgggccggcggcccctcctctagacgcgcgagtccctcccccgggccccggccctgccctccccgcgcccgccctcacctgcacggcccgccttggccatgtcccgggcggcgggctccggcggcgctacgcgcgctcctcgcgcttcccgggcccggccccgaccgcctccggccccgaacggactccgagcgccgcgcccgcgcccccgccccgctcgcctcggctgccgccaccgcagccgccgccgcctcgccgctccctcccgctcccttaaaggcgccgagcggcggccgcgccccccccccaccccaccccccgcgccgccggggagggactgacgaaggaaggcgcccaacgccgcccccgcgggcccgcacccccgccccgggccgtggccgccgcgctccagcccgctccgctccggcccgcgcggccaccgcagcgcgcgaggggcggcagcccaggggctcagagacgcggagacagcccgagacactgcgggccagagacggggccctggactgggagaggggcgcacagactattagacagcgctggagagagacgctcctagggccagaacgccgaggtggagggagagagagagaaattcagaggagaccagagacccagagcccggctccggctccgggagagacggacagagggagcggagagaggaaggaggacagggatccaagggaggcccccacgaagtcaagaggaaagtcgctctgggatcagagacaagagagggaccccctccatcagcccccgctccaggggttctggatcatttatggcgtctgacct

SEQ ID NO: 129 - DNA, 4456 bp, Homo sapiens
tgaatctggtttctcctctttaaccatctaaacttttactattgctttaggactgcctctcctcatttattgctatgttgattgcactgccctgccaaaccatattggagctggatcaggggaaaataagcatatatatatatatatatatatatatatatatatatatatatatgcatgaaaatatcctcccatattgtggaccaagtggaaaagttaatgaagctctacaatgaaaaaaaaagttgactatgagtaaagtctcatgttgtccaatctgtaatcctattattgtcaaccctcgtaagcccgcccagtggatgaggtggtgggagatgacgagggtgggatgggcattctgcagccagtggggaagaaggcagggccctaaaacaaacaagaacaagcatatctttatttagaatttggatgtattttcatcgtgaatttcctttgcattcattttgattaaaaaaaaatgcattatggctgggcgtggtggctcacgcctgtaatcccagcatattgggaggctgaggcaagtggatcacttgagcccaggagtttgagaccagcctggccaacgtggcaaaaccctgtctctaccaaaaatacaaaaatatatatatatattagctaggcatggtggtgtgcacctgtagtcccagctactttggaggatgaggcaggagaattgcttgaaccaggagacgaagggttgcagtgagctgggattgcatcactgcactacagcctgggcaacagagcaagactctgtcccagaaaaactaaaaaaaatgcattaaaataatatttatctgtattgctgaggtttgaggcaccctcttaaattttacacctaggcaatacctccagctctcacactaatccaggctctggtctattacaaaagtccccgcgggctctgacctacacagctgccagttaccttcctaacagacgaccagtgatcatgtcactttcttgttaatccagactgctgggagcgaaaattcagccccctcggtttggcgttgaagcccctttacaatctggcccccacctaacccaccagggcgcctgccctgtctggccctgttcccacctctcttgcctcatcaaacttctgccagactgcacctttgtccatgctctgctgtctgcctgaattgtgcccctgtctcctgaattgtgtctccaagccccttcacctaaaatattcctgttagctctcaagtttcacctcagatatccctgactggctgggcagacttcttagactctcgcaagcaggcttctttgttctgttttcccataggaaattgttcgtttccactcaattcatatcttggtggttgcattcatttttcgactgtgatttatctgtttaccggtgtccctagttccactgccagctccttgaggcgagcaaccggggcttttcatgtctaatgaataaatgaatacaatttgacacagtgaaaaaggcaggaacagcaaccataaaaaatccatgaaaaacaaaagcacagaggacaataggcagagaggacactggtcttttttttttttttttttgagggggaattctcactcttttgaccaggctggagtgaagtggtgtgatcttggctcactgcaacctctgcccccagggttcaagcgattctcctgcctcagcctcctgagtagttggaattacaggcgtctgccaccacgcctggctaatttttgtatttctagtagagacggggttttgccatgttggccaggctggtctcgaactcctgacctcaggtgatctgcctgcctcagcctcccaaagtgctgggattacaggcgtgagtcactgcgcccggccgacactggtcttaaaatcaggagaacctggatttggcttttggtcttgtcattagccagctttacaactctgtcattattttcagattttttactatggaaactttaaaattgtagcaaaaatagaacagcctgatgaacccacatgtacccatcatccaactagaacaatgtgggttcatcaggtttcttgtcatactgccccgctctgctacccccatccctggattgtttggaagcaaatcctagaccttactgtcacttcacatataattattaaaggaagaacatgaacattgtaattgattgcaaactcaccatgaacctggtggaaagaagagatcacaataggccgagatcacggggaagctcttggaagcaagttatgaaggaggaatacggattttggcagagaaagtctgtaagtaggaagctgtaaatcatgtgtccaacatgtggtgagcagattgttttatctggagtggggactgggtggcggaggggggtgagcagaggaaaatctaggcctgggacagagaggcagcctttgggcaatgggacagactggagactcttttagttttatgtaatgcaagggctaaggaaaaaactttgcctttgtcccctgaaggtttgctgaaaaatcaactgacaaaaagcagattaatagaagagaaggctggccaggcgcggtggcccacgcctgtaatcccagcactttgggaagttgaggcaggaggatcgcccaaggtcaggagttcgagatcagcctggccaacatggtgaaaccctgtctctactaaaaatacaaaaattagccgagcgtggtggcatgtgcctgtaatcccagctactcgggaggctgaggcaggagaatctcttgaacccaggaggcggaggttgcagtgagccaagatcgcaccactgcactccagcctgggcgacagagcgagactcggtctcaaaaaaaaagaaggcaaggtatataagtgtattagtgtgcgctgtgggaggagggaggaacacagagtgattacccatatcctagtggggtacagatgtttatatgtcttgttttttttaggggaaaaggagatggggaagtgtggatgattttagggaggtaacagatgatttttaggggaattcaatgagcttgaagaacatacaatggcttgggacaaagtctgtttgggcagacaatggtttgtgacaaaaatctttccaggtgtgttgaccgacttcagtgttttgccctgtgatatgggttcagttaatgaaaactcagggagggaatggatcagaggtgattgttttcttttttgccaggtctagacgttaggcagataagggaactccagagaataacttttattctgtgttttgggaggacagaaatgatgggaaagggaggaagatcagagatacattgaggcttcttcctcaattcagcatgtcaaagcgccatattttgggataccgctttctgagccccaacagtaactaggtattattttgaagggttgcattcacacttgtgacatggagtaaaggccagtggtaatatttctgtagagcgctttagttctgtctctcaatgtactttccttgttaactaatttctcctttagtagcaaaaggaattgtgacaggtgcatttaaagaaactgttacctgcaccaactaccaggcattcgttagttggggagaaatgagaactcatgttttccatactcagccctaccccaagatgacctggcaactgtacattttatcccactgggtttaatccttattatgaataacagagcgaaactttgttattcatgggagtggatttctcctgctgagagaattagcggcaatctcattcaggaagctgccttctgatgcaatgaggtcttttgaactgtgcataaatagaggccattctttaggcatttggagcatagggcttaaattgctccagaagttccaatcagactctaggtatctttggctgttttttttgtattttttttggttttttttgagacagaatctcactctgtcgcccaggctggagtgcagtggcacaatctcggctcactgcaacctctgcctcccgggttcaggcaattctcctgcctcagcctcccaagtagctgggattacaggcgtgcgccaccatgcccagctaatttttgtatttttggtacagacggggtttcaccatgttggccaggatggtctcgatctcttgacttcatgatccacccgcctcggcctcccaaagtgctaggattacaggcgtgagccaccacacccagccttctttgactgattcttctctgtgtgcgcatgtcctgaggtcacaagtggtagtgtgctccgtattggtttcttgacctgcctcttcaggactttctaaaattaaggtacaaccgattcttttgctgcagtcctttctgcctaaagaaggaagaaattcttctgttttcagaaaaaaaaaaaggaaaataaaagaatatgccagcttcaccaggataacccacagacattgagcattaggagtatggtacaaaaataatttctttcctcattaaggttttttttt

SEQ ID NO: 130 - DNA, 7958 bp, Homo sapiens
ataggaaattgttcgtttccactcaattcatatcttggtggttgcattcatttttcgactgtgatttatctgtttaccggtgtccctagttccactgccagctccttgaggcgagcaaccggggcttttcatgtctaatgaataaatgaatacaatttgacacagtgaaaaaggcaggaacagcaaccataaaaaatccatgaaaaacaaaagcacagaggacaataggcagagaggacactggtcttttttttttttttttttgagggggaattctcactcttttgaccaggctggagtgaagtggtgtgatcttggctcactgcaacctctgcccccagggttcaagcgattctcctgcctcagcctcctgagtagttggaattacaggcgtctgccaccacgcctggctaatttttgtatttctagtagagacggggttttgccatgttggccaggctggtctcgaactcctgacctcaggtgatctgcctgcctcagcctcccaaagtgctgggattacaggcgtgagtcactgcgcccggccgacactggtcttaaaatcaggagaacctggatttggcttttggtcttgtcattagccagctttacaactctgtcattattttcagattttttactatggaaactttaaaattgtagcaaaaatagaacagcctgatgaacccacatgtacccatcatccaactagaacaatgtgggttcatcaggtttcttgtcatactgccccgctctgctacccccatccctggattgtttggaagcaaatcctagaccttactgtcacttcacatataattattaaaggaagaacatgaacattgtaattgattgcaaactcaccatgaacctggtggaaagaagagatcacaataggccgagatcacggggaagctcttggaagcaagttatgaaggaggaatacggattttggcagagaaagtctgtaagtaggaagctgtaaatcatgtgtccaacatgtggtgagcagattgttttatctggagtggggactgggtggcggaggggggtgagcagaggaaaatctaggcctgggacagagaggcagcctttgggcaatgggacagactggagactcttttagttttatgtaatgcaagggctaaggaaaaaactttgcctttgtcccctgaaggtttgctgaaaaatcaactgacaaaaagcagattaatagaagagaaggctggccaggcgcggtggcccacgcctgtaatcccagcactttgggaagttgaggcaggaggatcgcccaaggtcaggagttcgagatcagcctggccaacatggtgaaaccctgtctctactaaaaatacaaaaattagccgagcgtggtggcatgtgcctgtaatcccagctactcgggaggctgaggcaggagaatctcttgaacccaggaggcggaggttgcagtgagccaagatcgcaccactgcactccagcctgggcgacagagcgagactcggtctcaaaaaaaaagaaggcaaggtatataagtgtattagtgtgcgctgtgggaggagggaggaacacagagtgattacccatatcctagtggggtacagatgtttatatgtcttgttttttttaggggaaaaggagatggggaagtgtggatgattttagggaggtaacagatgatttttaggggaattcaatgagcttgaagaacatacaatggcttgggacaaagtctgtttgggcagacaatggtttgtgacaaaaatctttccaggtgtgttgaccgacttcagtgttttgccctgtgatatgggttcagttaatgaaaactcagggagggaatggatcagaggtgattgttttcttttttgccaggtctagacgttaggcagataagggaactccagagaataacttttattctgtgttttgggaggacagaaatgatgggaaagggaggaagatcagagatacattgaggcttcttcctcaattcagcatgtcaaagcgccatattttgggataccgctttctgagccccaacagtaactaggtattattttgaagggttgcattcacacttgtgacatggagtaaaggccagtggtaatatttctgtagagcgctttagttctgtctctcaatgtactttccttgttaactaatttctcctttagtagcaaaaggaattgtgacaggtgcatttaaagaaactgttacctgcaccaactaccaggcattcgttagttggggagaaatgagaactcatgttttccatactcagccctaccccaagatgacctggcaactgtacattttatcccactgggtttaatccttattatgaataacagagcgaaactttgttattcatgggagtggatttctcctgctgagagaattagcggcaatctcattcaggaagctgccttctgatgcaatgaggtcttttgaactgtgcataaatagaggccattctttaggcatttggagcatagggcttaaattgctccagaagttccaatcagactctaggtatctttggctgttttttttgtattttttttggttttttttgagacagaatctcactctgtcgcccaggctggagtgcagtggcacaatctcggctcactgcaacctctgcctcccgggttcaggcaattctcctgcctcagcctcccaagtagctgggattacaggcgtgcgccaccatgcccagctaatttttgtatttttggtacagacggggtttcaccatgttggccaggatggtctcgatctcttgacttcatgatccacccgcctcggcctcccaaagtgctaggattacaggcgtgagccaccacacccagccttctttgactgattcttctctgtgtgcgcatgtcctgaggtcacaagtggtagtgtgctccgtattggtttcttgacctgcctcttcaggactttctaaaattaaggtacaaccgattcttttgctgcagtcctttctgcctaaagaaggaagaaattcttctgttttcagaaaaaaaaaaaggaaaataaaagaatatgccagcttcaccaggataacccacagacattgagcattaggagtatggtacaaaaataatttctttcctcattaaggtttttttttttttaatttatgctacgagaaatagaacagagtgagcctattgttgtcttgccatcccagaatctcttaggaggacaaagagagatactttagtgtttgtaaagggagggttgactatttgtgcaggtttcaaaactcctgcaccccaagtccccagcagaataagcctctctgggtccattgaatggtgggtttttgaatggtggatctggggccttgtatggcagatgcacctgacagccataaccgaagcacatcctaagaatgaccctaaggttggccaggcgtggtggctcacgcctgtaatcccagcactttgggaggccgaggtgggtggattacttgaggtcaggactttgagaccagcttgggcaacatggtgaaaccccatctctactaaaaatacaaaaattagccaagtatggtggcgggcacctgtaatcgcagctactggggaggctgaggcaggagaatcgcttgaacccaggaggtggaggttgcagtaagccaagattgtgccactgcactccagcctgggccatagagtgagactctgtctcaaaaaaaaaaaaaaaaaaaaaaaaaaagaatgaccctaggatctaagaagaatgtgtgtttggacttccaagctaaggaatcggagagtggccaacctggagattcactccttatctatgacagacatccgaacccctagctcgttccttggaatgcaggccacctaggggatggaggccctttgctttgggttaaatggaggttgctaggtgggagggtgctaagtgaaaaacacaatataaactgcatgcttagtacaaacagcagtggttctcctgtccagcctgctgcccctggaatgccccttatgtaagtcctcaataaaccctgtctccctcactagctccgggtctctctctcttttttaatggagtctcccaggctggagtgcagtggtacaattatagctgactacaggcatgtaccaccacgcccagataattttaaaatttttttgtagaggcaggggtctcaccatcttgcccaggctgttctcaaactcctgggcccaagtgatcctcccacctcagactcccaaagtgctgggatttcaggcctgagccaccacgcccatcctgggtctcttttttggtgcctcggacatggtgccatccctgcttggagtcagcagaggtcttacgcgacagtccttggaatggtggaagcctgttttgttgtctttgatactatgaagggacaaacccctgctttgaaggtgtttatttcctgaaatttttacctgggatcccagctatctctttctttctttctttctctctctgtctctgggatcccagctatctctttctttctttctttctctctctgtctctctctttctttctccttccttccttccttctttctttctttcagatggggtcttgctctgtcgcccaggctggagtgcagtggtgcgatctcagcttactgcaacctccacctcccaggttccagcgattctcctgcttcagcctccggagtagctgggattaaaggcgcacaccaccacaccaggctaatgttggtatttttagtagagacaggggtttctccatgctggtcaggctggtgtcgaacttctgacctcaggtgatccgcccgccttggcctcccaaagtgctgggattacaggcatgagccactgcgcccggctgcatgacttttctataaagccttattttaaatgattttgggggcttaatttaggtgttttcatttgcttttggtcacagtctttatgtgtcactgagtgtgtggatgtgggggttcttctacccagaggaaagtgatttgatcacctggaaccaggtgctctgagaactggggcagcttccctgacttgcaggagagggtgcagagacttcttcgctggcatgtagctgcagcctagaaaaccgcttggtggtcctcgttcatgaacctgccgttgggggtgcttcatgctttatcttggtctctaccttgattaatctcacctccgtttctccgctccactggaccattctctagaacccctctagaaccactggaccattctcttctgtcagagtccagtgcttccagtctttcctgtgggctcttatcttctggtgcaaagttctttctcaccttccacagtcaaaatcaccatacttacctaggccatacttactaggctggagaggcaggtacatcaatctttcttgtttatttgtttgtttgtttgagatggggtcttgctctgtcacccaggctggagtgcagtggcacgatctcctccgcctcccgggttcaagtggttctcctgcctcagcctccccagtagctgggataacagttgcatgcaaccatgcctggctaatttttgtatttttaatagagacggggttttgccatgttggccgaactgctctcgaactcctgacctcaggcaatcctcccgcctcggcctcccaaaatgctgggattataggcatgagccagcatgctcagccaggtacattgatcttctaagtatttattgttctgctccttattcagtgctaacatttttattttcttattctttttccctgtcacttgaagatcgtcacccaagcaataaatccatttggttgtacttatttaattttctctgactttctaaggagtgacacagcaaagtgccttatcttgcatttctttccttttccgtgttctagttggaaaggctcagagtttgggagaagttaaacgtgactcagagaattgcttttgatggtggtgccgatacacacatcttttgaagcttagattgggtattgtcaatttaatttggagtctatcagcctgtagtgttctaatcacctattttgaagccttgctgacgacccgagattccttgttaaactgccactggaataagcataacacttttcattaaaggaaaaagaaaatgttacttaaagtaataggcacacccttttattttcttgacagatagcaaagaaaaaaatcttctgtctttaccttgacaagacatgtaccattgctgggaggttttgcttgtatgagaacttcaacgttagaatctagacatctcggagaattgaaactcaacaagtttctctgttttggggtggagaaaaaggacaaaaagttgtcatatacagctagctgtccaaacagtcaaatacgaaagctaatttatcttttaaaaggttaattctttgatgcctctatcacagttagtgttaaaatgaaagcattggaaacaaactctttttctgttagctcagattttaaaaaaattctttttgcagagatgggggtctcactatgttgctcaggctggtcttgaactcttggcctcaagcgatccttctgccttggcctcccaaaatgttggaattacaggggtgagccactgagccagattttgaatattttaattacttaactgcttgtctgtctggcaatgagataagcgcagtagccagtgattaccaacagttaaacagaagaacaagtcacataaacaacacttatacttcctgtaaacccaattaaaaccacatttcaggtttgctcttatgatttagaagtaaatttagaatcagtttcatgaatcttgcagtatttttcaaattaatgtctttaggcatttggacaatgggctgtgtgaatgcaaactgcgttttcttcaattgctatcaattagagacagttaagaactcaactgatgaagaaatagccacctgaaagtgagcccacaggcaagtcacaggcccctcttcctcctgaaggtgcacgggagacttcgttaaaaaaaaaaaagctgtagtaaaatacgtataagataaaaatttaccattttaagtttcttttttttgaagacgaagccttgctctgtcacccaggctggagtgcagtggtgtgatcacaattcactgcagcctcaccctctccggctcaagcgatcctcccacctcagcctctcgagtagctgggactacaggcgcacaccaccgtgcccactaatttgttgtagttttagtagagacgagattttcgctgtgttgcccaggctggtctcaaattcctgggctcaagtgatccacccgcatcagactcccagagtgctgggaaggtgtgagccaccatgctcggcccattttaagcattgtaaattgtacaatttagtggcattaagtattttcacaatgctgggcaaccatcatcactgttcactttcagaactttttcatcattccaaatagaaattccacccattaaacactaactccccaatgtccccttcccccaccctctggtaacctttatcctatgttctgcctctatgaattggcctattctaggtacctcataaaagtagaatcaatattatgtgttcttctgtatctggcgtctttttcttagcatgttttcaaggttcagctgtagcccatatcagaatctaatttcttttcctttttttgagacagagtttcactcttgtcactcaggctggagtgcagtggcacgatcttggctcactgcaacttccgcctcctgggttcaagcaattctcctgcctcagcctcctgagtagctgggactacacgcgcgcgccatcacacccagctaatatttgtatttttagtagagacggggttttgccatgttgaccaggctggtctcgatctcctgacctcaggtgatccacccaccttggcctcccagactgctaagattacaggtgtgagccaccgtgcctggctaaaaattctttttt

SEQ ID NO: 131 - DNA, 112750 bp, Homo sapiens
ctgtatatacgtaggaaaacattcttttttgtcaacttgacgttgacaaacttggtggatgtcaggagtaagggtattcaagagaattttgaagaagaatttaatatagtgagtatcgaagacaactcttaaagagtcttgcgttcaaggggttgtgagaaatgggttgttaatggagggcaatgtagtatcaaaaagctgtttaagattgatgatatagcaggtttgtatgctaatcagactgattcagtagagagaaaaaacataatgccggaaagagagggatattgctgaagccatagacctggtatacaaatagaagggttcgttttaaagataggcacacaaacagctcattagtaacggtaggatgaagggcagattatggagttctagatgtcggtagttcagtaaataggagcatgtcaaatttttgttatattttctcagagaaataggaaacaaggtcataaagagggaggaagtcatgaaggattaaggaaggaaaaggagatgtaaaatgggtatccaggaatgtaggaaagtaaacatactcttaggcaatctgtggtttatttaagtggtatcagtcaatgtggttttgtgtttttctccagttgagttcagcataggtgctatcactgaaaaagtacagaattcaatttaactaaagttgagatttccctaggtgaataagacagtgatgagatgttgttacatttaagagaaagataataaaagagagatatggaaagtaatctgggttaaggagtgaagtgagaaaataaagaaggttgagacagtggaaaatggtatcatcaattgtagattgcagtgtggttgaagatgcattggagttcttgaggtacaaactagaaatttgggagatttaaataagagtggggtggctgaaattgaaattagagtataataatatataatagtactaagtatagtatactaagtatagtataatagtactaagtatagtatactaagtatagtataatagtactaagtatatagtacttagtgattataagttttaggatgtgaggatgggagtagcatagaggcaaggtgatggaaggagatgaattcaagaaattgggaacctaggagattgaaagcattatctaaatgaattttgaaatctcaacaagaactgtgctgagtgctttttgtaattattttatctttactaccctgtgagaagacagcacttccttttgtgagtaatggaaagctctttaatgtgtcaactgtaagatactttattacatttaattatctttagtaattcatgctaacaaataatgacctcagtaggattattcagtagatatgtgagctaaccccctgtgtcagacacctaagagatacaactgatgattttcaagaagaatagagttctcatcccaagtacttaagctgcaaaatgtcccaccctatattttctgaaaacaaacggtatatagagcgtccatttaaaagctaataggaaatcttaaagcgtgcgcgcgcgcacacacacacacacacacacatacatacatacatacatacacacaaaacattgaataagcatcaggaaatatataccctgtacccaacatgcacaaggtctaagcaatgaagaaaaagccaggatatcaagtaagactggaacatctgtgactaatatataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatgattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaacaatagccaagtgtgtttcttttcttacatatacagtaatacttatatttcattaatttttagtaaaagctctaattagtaatcaacttgtaaaattcacaaaaaaaccaatagtattaaaatcccacttaattgttgaataagtgtaagataataatagtcagcaagttgttatgctttagaagactgactttaacctatttaagctatgaactcagaaaagcatctcaaccaatatgtttgttgccattagcatcatttaccgagctgtgtacctttaatttctgccattctataatccttccaaggagtgtttttatcagttagttagggatagctggtttaatgctgattcccatgcaaagttagcccggttgtatgctttttataatatgcaagtacttctggtgttaataaggttaaaaaatagaagaaacctaaattatacaatctacagttatcagttctattgagctcactggaatcttctcctactttatagacttccttctttttcatttttttcctaattgcttagacttgttgtatatgactttttgttctttttcttattctacaatctggatatttatttagggctttcatgacaccttgtagtctgggttttcttcccaattctctacctattcattcttcttcatcttgactttacatatggaattcattagggctctcatctaggtttccttataactctcagttgttttgtttatgcttaaatgagaacatagaggccataactcagaaactgtctattcttcacctataaattgtccctgccacaaagcagattcactgtgcattggtaccacttcggctcactgcatcttgggctgcagtttctactacttaagattgagtccagtgatttagaacatacacacaaaaagttgcatgaagcaggcttattgcttatagataggcatcaagtgacacagaagcccggcgttcaggaggagccagcctcccaagactcagaccgtttgcccagggtgttgaagactcatttgcacatgccctatttgtaccacagctgagggacccttgaaagaagcctgccccgtgttttataacccaggcatcccatgatacactgggctaaagcacttaaggaaatgttctaagaggcacagtaagagagtctgagacttatctcaggatgttgcattcccagctcattctacagctattcttgagatgcacaagttatagaggaggaaaacctgggttgctccaaggccacttggagagttgtcctgcatttcctctagcattttccttttttttctcctattacaataaagaaagtacatgtcattctaagaaaggccattttctctgcttaagttaatgataccattccatttttatcttttggaggactttagattatcctccctcttttgatttagcagtctttccctttcttctgcattagtcatcctagattacatgtattacagtcttccaattaaaaacatcaatgaccatcctcagatattcttctgggtatattactttgctcatttccttgctccctctcctaattaaacatctctttttatcacactgtctccacatcctcagcctccgtcattattcatctctctactgtccagttttcaccattatcacttcattcagtctgctcttgtcaacatcatgagtgacatttatgttaccagtccaatatatttctctgtcctcaccttaaaccacttcatagcagtattaatgatggtgggtcactttctctttctatcttccttttttcgtgttattctactctcctggttgccttctgtctcattgattgctctgtttcaggtttttgtttttttttttatcttattcttaggtggatcatcttattctgttccacctaagtcctaacttttatctatttctcttctttatcttctcttctctaggtgattggaatcatttccatggattttaaacaaatattttctgtggacacctaggtatcttcaattcagaacttggacttcagcctcatacttccatcagatgcttgttatcaccacttccatgttccacagacatctcataattaacatatttaaaatggaaccctcattttttttccttgcataaaccttttactacattattttcttactgcttagaaacccaggatattttctgatttatctctcttagctcaacaactttatctcttcatataaaccttagcatgaactattaattgtatcttcaaaatatctcttcatttattgcacttcttttgtatcttctatcacccctttatccagctcacaattatctgttctctgcattccaaaacaactctgcaactggtctcctatttccattattttactgtctccctttattttactaaagaccacaacattatattcatacaatttaaatccaattaaaatgttaatgcttaaaactcttaaatttttattgcattcagaataattctaaccactcatggtagcctacaaaatcacaccttatcagacatgaacctcagttctattcttttcccttgacaatcccatagccttaggtattctggtctttcgtcattttattaaatatgccatgtatttttattttatgttgtggactttttgtatgtgtttctccactcttttggaatcctcttaactgagttcttagcatggttggctcctgtttttataagtactcccaaacacaggaactagcattaccattttttcagtcctgcagttcagaaatctggggcttacgtttgaaaccctcttctcttacatttcccagaacaaataaagcactgaatactttagatttttgcattctatttcttcactatattattttctctttctacttctactatctagtaacccttttcttcaatgaccaaaatctattttacttccagcaatatggtgaaaagactatcgactcttaatttaaagccagactttattgtttataacaaatgcattgcagaatgtaaacagagaatgtaatcacaagccaggggctgggagcacttcatattagtttcttaacatgtcagaaccacattctttcatttttataagagagtaaccagagagccactttaagaatttttagtggttagcagaggagtagaggagagtgcccttgatacacaggtagtggtgaacatgtatctttacccccagcaggagagaaaagataaacattagagacataagctagcaagcttcaaaaaggatatttgaaaggggttttgtaatgggatatcagtttttgtacaagggaatttatttgtacaagaggttacggagcttttctcggagaataaaacaagcctgtctattacttgaaattttaacttttagaatagcttacgtgcacttatgctgattattgaggggttgactgcagcatcagcgtccacttcagtcctttctccaaccattccattatctaccatgcgatcagagtgatcttttcaaatcagataaccaccaccacttaccttaggataaaaagccaaaattcttatcagggcttgtaaccctgtgcttgaagtcttacctcactcaattctcctctttaatttctgatctctaaccatgctaatcttttagttactgcaactcaacaagatctttttagttctttaatttcaattcaagagacattctgctctttctgcttggaatgctcttttcttacctcttctcctaattaactcctgttcatcattcaaatcttaattcaaatgctgatcctgcatgaatatttattcagtattaggtcaagtcccctgatgactgttagcaatctctgtacttcttatcactcagcatagtactgtgggaaatatctgcattgttctttattgaatccttagtctcaggacattatccagaatgtcttacgaagagatcaataattatttgtaaaatgaattgagataataataaaagagaaaaataagagaaaaaatgtatctatttttgagaaggagaacatttttaatgaagatgtggccctggaatacagatgtttctctcatttttttcctatttcttcccaaatttaattaatttctggttaaccctgatttctcagatcataaaaatcatggggaaatcaactactttggcaataacccatcatgttttcaggatttgtaagccataacaacagtaaattctttggtgagctatactctcagtaagtaaatgaagaataattcaaatattattgggaaaatgatgccacattcatctgaatataataaatgtgaaattcattttactatgttcttagaactttgtaatactaatttataatagcagtttcatcctttagatatttcattttatctacggatctaattcttcctgtgaaattactgagctatttctctattcttagaagagaaaataactctttgtgataaaaatcattactatgtataattagacttccgtttacaagtcaaactgaaccaacgaacttacaatcatagaatgtgactagtcacagggaatggttggggcattagctcagtacctgtccaaagtgagctcattattatgattattagtatcaccattatcaatcagcttccacataaagtgtacctaaatgctagatctatatgatagcttccaaaatgacactgatttttaataatccaaatctttaaagagatcactttccattttagaaaaatgagatttttttttttttggaaaagatagaaaaacctctaagcattttaaccaagggttttagaacactttatttttatgaatatatcaaagcaaattccttctttattttgaaagtgactggaaacaatttcacggtcttactaagggctagtttaagtgagtctcaatttttcttctgttttgtttgctcttacaactttcctcacacacacacacacacaaagggagatataaaaaaatctagatataacagatgcaacttacaattttttggtaagaaatcataaagttttagaaaaaatcatttaggagtgtcaataaaaacgatatttaagaaaacagtaggaaaagtgatatattaaaagacttttaaacacctttcacaagaaattgaacagatgtgcaaatacacattatacgttatctatttgctcattttatcctgtccttaaacataaactttgaagataaaagaaagaagtgtggctcagggtcactcatgtaatctgtttttaggcagaaacaggtgtgttgaaaggtttttaggtaaaacaaccaccacttagacttcaataaagtagtatttattattttcctataattgcaaatttaccaaatgtaactcactattttttctttaatattttcaaagatatttttgagtaattattatattttcacaatcaattcagtagacatttttgaaaaacttatctgaacctagttttctcatctgtgaaatggaaacaatatatactctctcagtttgttgtgtcaaatgagaaaccatatatgatatactaaccactggttctggctaaatgcatacctcctcatcttttcagtaaagacatgactgttggccaggcacggtggctcacgcctgtcataccagcattttgggaggctgaggcgggcgaatcacttgatgtcaggagttcaagaccagccggaccaacatggcaataccccatctctgctaaaaatactaaaattagccgggagtggtggtgcatgctggtagtcccagtcccagctactcgggaggctgaggcaggagaatggcttgaatggcgctgggagattgcagtgagccaagatcatgccactgcactccagccttggcaacagagtaagactccatcccaaaaaaaaaaaaaaaaaaaaaaaagtaactgttattctcagtactttgggccagcacagtactgatactctcctaaaatctaactcaaagagaaaaatcacaaagcattggaattggagcagaaagtaatgtattcttgtttgacatctttccacattcagtctgtgtactgttagctgaaagctagttgacacaaaatgctgtcttaactttagtgttgtttctaatttagttctaggtcataaaatttgtaggaaagtctaattccaaaactttatcaacagctttgttacgctcaggtattatgatcagatatcttatgtgtgctctatgacctcaagcaaagattaaataaatctgtacattacagtgaagacccacatcaaccaatgcaacatacatttatttttcgcagcactcttttaggtgctttgaaacatgtaacccatgtttaagtgcagaggatagctggcaaggcaaaatataactatatgatgtgttaataagaatacagaggaatagttaaagtgatgcataataaagtacggaaatatgttgtttgatttcaaaggaaggggatagtacatatgctgaaatggcctgggaaagcttaatgataaggaaggtcttgagatgggtaagagagatttgtaaggaagagaaaggagggaaatttattccaaaagaagaaaaagtatgacaaaagcacaaaggaataaatgagatgaatggcagaaaatagatcagttaatcagtgaggctagagaagcacgtttatggaacactagtgaaaaatatgatgaaaaggtagaatgtgaccaataacagaaggatccattttctatcaagactttcttattagatttgatatgttcataccagcaatgtcatctctgaatataaaagatatctgtacttacgcaacataattatatgttatcactgggaaattctaggaagtaattatcagtccctttattaatattactatagaattaacttattcagttatagggtacactacgtttatagtttacttccttcctcccccagcctccagctttgtaatttaaatgaaactaaattccatcataattcactcactaacacataggactgccaacctctgaatggctttagatttgcgtgaacctgtatttgtcaatgcttgctccaggattctattggcatatgtcgaaataattgatttttatgacaacctgcttcctgcttactgttttttaccatagggagggaaaaaatagaattatcccttgatttagctgtcagtcaaatgacaactcaagcatgctataaaattaaagaaagccccacattctaccaggaactgatgattttagtgatactgctctctttgtagaagaaataaagtattttcatatcttatgatgaatatcactataatacattaaaatatagaattgcatccagcaaaatatcctgaagtggacaaaatatgcccctccaaaatatgccatttttgcacaataatttttttgagcagaaagcaattagctcactgactttcacctttctaaaagcaagacataaatttcaatttgtaaagacgtctccctttagtgtacttgtaagaaaactactccatagacaactcttaatagctgatgacttatctgcataagaaactttattaaacaatcctgatttagaatacatttcttcccccactttcccgtaacttacctcctgcaccgagcagccctaaacttcttttctttggctagtctaagatatacaccccaaatcctaattgcctctttgcatcacatttctttgtgaatttccatgtgtatgtacataattaattgttatttttcttgttaacttgtctgtgatcagtttaatttgtagggtcccagacactgaacctaggatggaagagaaaaagtgtttctgctttcctatggcttaggcaaccatgaatggacaggcagggcatcccacttgctccagaggctgcagctcaattgagatctgacaaagctgatgtgaaaactttactgaaccagatcctggaattttgcctacaaaaatacaaatacagaactctgttttttcttttccaaattcagatttgcacgagaataaaattataagaattagttctttggaatgtgattctggtgaattttctcctgagtatcattggttattgaccctttcactcccagggagagccattgctttcctgtgtgtctcattttgtgtcttgagcgcttggattcactttcttcctggtggcagggtccacattgttgggcttgctgtacaggcagtcagtcatcagattgtatgccctgagaatttgtagatggtcagatagagatgcaggttgcactgtcttgctactgatgttctaccaaccctctcagagggtttgtctaaatttttatttcttttggctattgctgggaggaactccatatcataaggacttcatttttgcactctctttgtggatacctcttacgttcttggctatctacattattaaatatgttttttccctctcttattaatcttttatttatttaaaagtggtgggttcccatggccttgggcatctctgcctctgtggcttcacagggtatagcctcatcctagctgctttccccggctggtgttgagtgtctgcagcttttccaggtgcagggacaagctgtcggggaatctaccattctgggatctggaggaaggtggccctcttctcacagctccactaggtggtgccccagcagggatcctgtgtgtgtgctctgaccccatatttcccttctttactgacctatgagagtttctccatgaaggccccgccactgcagcaaacttctgcctggacatctgggtgtttccatatgtcctgtgaaatctagggggaggttcccaaacctcaattcttgacttttgtgcacctccagctcaataatacatggaaaatgccaaggactggggctaccaccctctgaggcaatagcctgagctgttccatggccccttttagccatggctgaaggggctgggatgaggagcaccaagttactaggctgcacacagctcaggggtcctatgcccagccgaagaaatcactttttcctcccaggcctctgggcctgtgataggagagtcggctgtgaagacccctgacatgccctggagacattttccccattgcctttgagtttaacatttggctcctcgttacttattcagagttctgcagctggcttgaatttcttctcagaaaaagagatttgccttttcaatcatatcaggctgcacattttccaaactcttatgctctgtttcccattttaaaactgaatgctttaacaatattcaagttacctcttgaatgctttgctgcttagaaacttcttctgccagatacactaaatcatctccctcaagttcaacagttcacaaatctctagggtaggggcaaaatgccactagtctctttgctaaaacataagaagagtcacctttgctccagttcccaacaagttcctcatctttatctgagaccacctcagcctggattttatatcattattgacattttactcaaagccattaacaagtctctagggagttccaaaccttcccacactttcctgtattcttctgagacctccaaactgttccagtctctgtctgttacagagtcccaaagtcacttacacatttttgtgtatcgttttagcagcacttcactcctggtaccaatttaccgtattagtccattttcttgccgctgataaagacatacccaagactgggaaatttagaagagaaagagatttattggatttacagttccacgtgcctggggaggcctcacaattatggcagaaggtaaaaggcatgtctcacagggcagtagacaggagaacagagcttgtgcagagaacatccccttttttaaaccatcagatcttgtgagattattaactaccccgagaacagaacagcatgggaaaacctgccaccatggttcaattatctcccattgggtccctcccacaacatgttgaaattaaaattgggatttgggtggggacacagccaaaccacatcattggggatggaactttttattgtgagtatgtctgcacaagttacctgtgtagattttcttgtctgtgtggctgtgggaatgtcttagtcaaacacccctatgcaagtttacttatctatgactatagtttgattttttaggctgttcttttgtttgaatgaattcaactgagtacccaccctaactgcctgcctgactggtttgtttatttctcctctctcatttttacccacgggagtggagagcctaactgctgttagcgaggtggggtgatgctcgctacttcctgctggaaaggggcattgtatggggaacagcagctagggttccttctgtgagctttctaagggtccttggaagaaatttgtgtccatgcatggtttcatttgcatcaacatttgtagtttgatagactttaggcaagaaaaaaaaatggattattagaggacatgtataaaaatgaaacaaggggataggtaatgaaagctcaaaaatctcaaggcttcagccatgcccagataaatagtggctatagttatgcctactaagatttgggtgcatggggctttgctttggtgaacttccttggttttattttcccaaacaaagaaacctctgggttatgggtaccctgtatactcccataacctggtaggatttgcaggataatagcccaaaactagaatattgattcagatttttacactacttattccttttttattttgagttgcagccagagattgctggtttgtttacaggaataagcagagttattctaaaatgtacgtgatatggtttggctttgtccccacccaagtctcttctcgaattgtagctcccataattcccatgtgttgtgggagggatctgtgcgagataattgaatcatgatgggtgtttttccccatactgttctcatggtagtgaataagtctcaggagatctgatggtattataggaggaaatccctttcatttggttttcatcctctttcttgtctacttccaagtttttgccttccatcatgattgtgaggcctccctaaccatgtgaaattgtgagtccattaaacatcctttttaaaataaattacccagtgtcagatgtgtctttgctagaagcatgagaacagactaatagagtaggcaaaacttaaaaacaactaatgagattagaatttaatgacaagtgtatgataagttttgaatcaaattttgctctctccagtcctcatttttgttcaaaacaaatcatgatagtcattttgttaaaaacaaattacgactgagttgtttgcaatgtaaacttaggctcatacttggcttgattatttgcataatgtgcagcaaaaataattatttttgcagtcttttaaaataagctttgatggaactctgttccacaagagatctcagataggacttttttaaagccaagcccggccatgagtttgtaccctcaaatacctatgagttgagtgaattcctctcttcttaatgtcacaagaatatgtggttcctgggactgttatatagtgacattctttactcatcacagattagaaaccccgtacacagattatgtagacaaggtaggaggccacatttcccaatgggcttttattggctctgtaagtgaagcttgattcctcaaagagaagcatatccatccaatcaaagccttggtaaaacaaccagtttctccaattgtgtcatgttgcaaaagaaaatgaattcttactgcactggtgcaaacaacgatattgccataagtttagaatattcccaaatagtttccaaattctggagtaacttggcagagagaaacaaatacgctccaaattttgttcactggtgtataccttacttaattcttaaaagctgtagatagcttaaaagaaaggtttccttaactctgaagaacaaaacaaagaacagcaatgttttaagcaaaaagtaaaaaaagattatttcagacttctattagtttagttcatgcagttaactcctgtctgatattcataaacagttaagatcttcatgactcttgtatgatttcttttattctcatgtcatgatttccaaagttatcagaaacctgcatttgagagcacattgtaaagtcctacagctgattgtaaaacatcttttgaagaggattaaaacaagacaacatttatctgtagatgacatagtgttcaggttagttacagtgaaaaacatgactggcaaagatatttggttatttctgtggtttgcaataacttaatacaataatcctaattatgatccatagcatattctcaagcattagaatttttaaaatcccatacaattttggaacatatattaatattatcactaaaatataacctgaataaggttaaacataattttgtcaatcccacttacatgaacctgtcaaaaaattctgtttacttctcttctggatgcttcagggccctctgtagcatacaaaaggtagggttcaggagagacaattttgaatgtgaagtttgattttgggaagcctgtcaaatgttacaggtttaaaacacttgatagtgtgaaatacaattccaggtaacacataagttatttattttggcaaaaggatgactcagaaattttaaaactaggcaacatcctttactccttaagagggaggacttcgctttccaaacagtttgtctcctgtctactcttttctctctttggcagtctcccaacaaggcaaacaaaatatttcattattcttctctattacatgaaaaatctgtacaagggaaagaaagccaaattttacccttacattggtttcaaaataatcctttttcattggcaaggtttatattttatgcctttttataatcttttatgacaaacacattttactgttcttacacaccttgcaggtaaatttatttttagttgtcttatttacatgttttaatggtaaatcttaccaattttaacgttaatataaaacctggtaagttgttttaattatgtactagatgcagataaagtctgatttttccatcatatttaggggcatggttaatttcatatgtccccaggccttaccaagttgtaaggtaggtagcatacaaccttgaaacatttagcaaacctggtatctaacttacatgatttaaactttctatttacattttgatgacatttgcattgtaccaatttcatctttaaaacaattactatttcttagaggttaaagtcccataaactaaaaggcattagagttttaactttcctctaaaatatttgatttaagtgcttatttttatttaaggcaatcaattagagctcattagagacatcacacacaacacatatatcactacacaggcaaacagaagaagatccagtagttctaagatttttttcttgtcccatttcctaattgaattattagctttccagtggagccctttaagagcaaggatagaaaaccatgaagtttctagggcctaatcaacttgtatagctgtaagacaaaagcagattttgagtggaatctatctatgagcctctaaattctggtattccatgaggaaaacagaggtttctcccaaaatggaacccatcatgccttttctgtttttcccaagaagtatcaggccagcaaaagttatcttgggttcattaagagtggaaagacagagtggagaaaacttattcagtcaaaacaaaagttatcttgggttcattaagagtggaaagacagagtggagaaaacttattcagtcaacacaaaagttcttttcaagaaaaacacaatccaagaagagaaaaacataaaggccttttaaatatacctataacatgaatatccacttttaatcaagctgagcattctttaagaaaatcatttgaaatatgctgttacctgactttagctaaatcaagcaggtaatatttctggcttttgactttaccaaaagtaatatcaaaggtgaaacaacaactctcaattaggttataagttaaccacgagtatacaagatatcttataagtggtggtaagcagcttttaccagatctagaacctttaaagtcaattcagagaaaagaagatttcagaaaggaagttagagttgttcatggaggaggaagagaagattaaaagtcacacagctattaacttgtaagtattcattacccaaaccaggagcgaacccgggccaccattataaaaaggcaatggctaaaaagaagtactgccacattgttacaggttatggtcaaggacataaaacaagatggagacttgcagcaaagtttgttactaaccagtttacaggggtgacttgaacagtgagcttacggagtcccaggcctggattccgttccaaggtaccctctctctgattgtttcttgtattttctctcctttttctgagactcctcctagtacctgttatgaaagactggggtggctactcttagaaggttttttaaggtgccatctggttctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagggttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatttcttccaggcagaagctagaaagagaggtttgaggtttaacagactgtcactatatatgcctcccagctgtagaaaattaacttgtctcattaataaactgttcaaattcatttagcagtggtgagcttttacatgaaggaaaagcaactaaaatggagagggatgagggtattcactcgggatgaaatatcttttcatagagtaccatgaatgactgttattgtgggacaaaaagcacttactgggtgaaggtttagactgaaatcttgaaatcccctggtattttgagtttctgcttagcctttccaaaggaataaaatcagatatgtatctatctcagtgagcagaggagtgactttgagtagaatgggaggaaggtttgtcctaggcagtttcccgcttgaattttccctagtgatttcaggggcccagtatattgtcctttcacacatctgacaagtaattgataaccagaatatctaagcagctcaaacaattctagaggaaacatatctaatagttggatcaaaaagtgggcaaaagatttaaatagacatttctcaaaagcagacagacatatggcaaacaagcaaatgaaaatgtgctcaacatcatcgatcagagaaatacaaataataactacaatgagatattatctcaccccagttaaaatggcttttatataaagacaggcaataaggattgctggtgaggatgtggagtaaagtgaaccatcatacactttttatggttatgtaaattagtacagctgctatggaaaacagtttggaggttcatcaaaaaactaaaaatagagctatgatgtgatccagcaatctcacagctaggtatatacccaaaagtaagaaaatcagtatattgaaatgatatctgcactcccatgtttattccagccctgttcacaatagctaagacttggaaacaacctaaatatccatcaacagatgaatggataaagaaaatgtggtacatacatacaatggagtactattcagctataaaaaaaaatgagatcctgtcatttgcaacaacatagatggaactgtacattattatgtgaagtaaaataagccaggcccagaaagacaaacatcacatgttctcatttatttgtgggagctagaaatacaaacagtggaactcatggtcataaagagtagaaagatggttactagaggctgagaagggtggatgggaagcaagtgggaatgttcaatgggtatagaaaacagaagaatgaaaaagacctagtatttgacagcacaacagggtgactatagtcaataacaacttaattgtgcattttaaaataaataaaagaatataattggattgtaacataaaggataaatgcttgtggtgatggataacccatttaccctaatgttattattacacattgtctgcctgtatcaaaatatgacacatgccctgtaagtttatacacctgcaatgtaccaacaacaattaaaaatttaaaaaggtgtatccttcccagtgaaccaaaatattttacattgataacttttaagttatcatagtgtgttggaataatcacagctttggaaagaaaaaaattatagatataaactttcaaagatggcaggagatatagatctctctttagtggattaaaatatgccatttgttattaacatcacactgagattttttaacacaggacatcttctggaaatgatatgattataggagttataggaaaaagcgttttttcatactgtgattacctatgctatgaagaaaggagatatttcctctatgatgtctaatttagcataattattgtttttaaactatatttagatttaattaagagatacacaaacaaattacttttagtagtaagaagatttttaaaaattttttgtgtaagatgactatgtagtaaagaaggttacaaacttactttttaacgtagaaaaataatctcaccttcttgccccatggaaaattgaaatgttatgtggaacccagtgtagaaaaactctcagtgaggttttctgtcttaagtttcagtggattgaggtgagatcaacgcctgttccacctttttcctccctgtcctagcaggcttgaaaacatttatacagccataaaatgttgcctttaaattcaagtatagaaaataaaatttaaaatgtgatatttttatatattttattttaatatcttacatgggaaatgtttttgaaatgttaaaaaattaaaatttttaaaagagtactgtgaaataatctaatcacatgtggaaattttgttactatttccccaagcatttttggtacatttaatgagttgaatgtaactcataagtagataaaaatgtttaatatttaattttctgctgcaataatgttacaaaacaaccttaaattctcagtaacgttaaacaacatatttttttctcccaaatttccaggttatttaagggcagttctgcttcatattgcagtttgcctgggctttactccaggctgtgtgttggagttaggtctaatatattgtatccctacgtatcccagttagaaagcctaacagatttctttgtacttcagtcagctcgattgtatttgtcattcaaaagccaaagcatttatcctaacaccaattgcttcttttttttttttagatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtaagccactgcacccagcctaactgactgcttcttttgttctgtagtctttctccaaaactgtttttctctgtactcactttcaccttctctcacacatatatgtccctcatgtccctttatgtctccagggtcttctatttccacgtaatcttaattgttcatcatatcctggactcatgagtaattaatctgttattctccctgaaagtgcagccttgttgaatagaatgtgttctttaaagagcagctttgtttctcgagtgaggtattaacttccagatttaagtgaaaatgagttccaagttttatgtttcattgtgtgtctaagactgacaccgtttattactgtggcacttacagcttgctttcaatgcctccaaattctctatctgaagggctgggtaccatatctcatgtctgaacatattcctcagaatcatgcagtaccagctatgttccttctttatattatggctcctgaggtgcctgttaagcagccaggtgaaattgccttttaatcagtataggaacagtctctttcctgctgatgctaatgctttttgtaaaaaggtcatgctgtattgaagttcttctttcacggcaaaaccactaatggaactcatctacttactgatgggtggaagctctttgtatgccaaagtcttgttttgtttgtgaagaatctctttccctcaacagtgatgtgctacgttaggtctcaaatcattgttgctttttaatccaaatttatgacaaagattttcagtttgtatgcataatttccttctctggccttaaccatcagtctgtggacttgccaagcaacaaccacaagaacaacaagtctgaggtcaagagacactatttagatctcagaatcatttgttgtcctttatcctttgacaaagttttgcctttctttctttatgagattttttccctaatggtttctcaatctcttgagaagaagaaagttcttgactcttgcagtctttctcattagttgaattataccatcagtacagcttctgatcatgtcgagaaatccaccatgaagaaataaaacatttccgattacatggattacgtttcttggattcttataggcattaaacttcattctaggatacaacctcatgatcttgtcttattctcagaacaagaaatatattactatatacattacaatatatatatattgcagtttccttgctatatatatatatatatgtatgtattatagtaaaccctgtaggcaagcaggaacacttcagaagtctcaatgaatccatcattagctgttagtaatgacaacactgttagaattatttcaataatcacacattgttatggtctgaatgtgcacccccaaatgtaatatgttgaaattttaacacctgagggcatagtattaggaacttgggagtggaactctttttagtgctattatgaataagatgcttgccttttccagcaaatgaggacacagccacaagctgccctctaggaactatgaagttagtcttcaccagacacaaaatctgcttgattttgaatttagcctcccgaactgtggaaaataaatttctgcttttataagccactcaatttatggtatttggttattgtatcccaaacagactaaaacacacattatttacctcctttttggactgtctggggttgttgctttaaacttgcttcagtgcctagaactgctccaagctccctgtcctctggcacacacgtataaataattctgctggaaaccgacatgtttcactcagtcatccaaatgtatttataatgttgtccaaatatatagcacttgttacaatgtttacattttagacatattttgagatatgtgccttaacagagtgctgtgattattattaatatttagtaacttatcttaccagacctaaactcaaagtttttcacaatggcaatgccttatttgggacttatttgggactgaatgtatgaagatcttacattgagtccaaattgatttctctgttagtctcgcaataacattaaagccacagaattatctgctgtatatttcttgtcttgttgtagctgatattctacatattaggacaattaggacattagtaatatctattaaccttagaataaaatgtcatattgaaattgaagaggaatattggaactttgctaagaaagaatgcttttcacacacaatgatatctaaaatggagcctctgttcctggaggtatattttacaaaaattcagtgttactataggaattctgtacacttctttcttagacatttgtattccatcagtgtcagtcctctctgtattttaaactaaataggatttctttttccatctttctgtttgacaagtattgttttgctgaaaatttgctattcatgttcttttaactcattagaaagaatatttagggtctttagtgacaaatgacatggtataaatgaaaagaaaacactgacattgtaattgagaaatactaattaattaggagaatattatttaaaaacattgtttaaatatttctttgttttattattattatactttaagttttaggttacatgtgcacaatgtgcaggttagtacatatgtatacatgtgccatgctggtgtgctgcacccattaactcatcatttagcattaggtatatctcctaatgctaaaccctcccccctcccccaaccccacaacagtccccagagtgtgatgttccccttcctgtgtccatgtgttctcattgttcaattcccatctatgagtgagaatatgtggtgtttggttttttgtccttgtgatagtttactgagaatgatgatttccagtttcatccatgtccctacaaaggacatgaactcatccttttatatggctgcatagtattccatggtgtatatgtgccacattttcttaatccagtctaccattgatggacatttgggttggttccaagtctttgctattgtgaatagtgccgcaataaacatacgtgtgcatgtgtctttatagcagcatgatttatagtcctttgagtacatagccagtaatgggatggctgggtcaaatggtatttctagttctagatccctgatgaattgccacactgacttccacaatggttgaactagtttacagtcccaccaacagtgtaaaagtgttcctatttctccacatcctctccagcctacaatgaactcaaacaaatttacaagaaataaacaaacaaccccatcaaaaagtgggcaaaggatatgaacagacacttctcaaaagaagacatttatgcagccaaaagacacatgaaaaaatgctcatcatcactggccatcagagaaatgcaaaacattgtttaaatatttctatcacaaattgacagcagtacaatgcacaccaccagcaatgtataattctagatatgagaggtaaaaagataaaacaggtattgcattttctccagaaaacttatcatttagtggaaactggccaataatttcttaggccttaggataattttacctttgattctctagttaatccaaaatatataaaaatattaaccaaaagtatatatttttaaaatgcctacataatctaatgcagtattttttgctctcttcttgaagtgaattaaattccttatcactgaccataaaattgaactccattgatgattcttatttaaaatagttaaaagtgaatgtaaagatcagttgtggttttccttttcttacccttgtttttacacttatatttgcctgtgtcattcacacacttttagaattcaaaacaataactagaaatgtaatcatttgcttttcaaaagcttttcgcatctttccaaagttaatataaagtcttacaaaacttttagctaattcacaaaaaaatcaaacatatatagttgaagcaattttttttttttggtagatttcttcaaaccacagaaatttcagttatggcatggtaggtcttttgaaatgtttcattttttgtatttgaagatgcagagcaaaagtatttccactccaactcccctttaataaaaattgaatgtaacaaaaaaatcaaaatctataggaaaataaccccttcatctatgttaaaactatgagatttccagcccaaataagttataagaaccagtatagagtccaggctcggtggctcacgtctgtaatcccggcactttcggaggctgaggccggaggatcatgagttcaggagatccagaccatcctggctaacatggtgaaaccctgtctctactaaaaatacaaaacaaattagccaggcatggtggtgggtgcctgtagtcccagctactcaggaggctgaggcaggagaatggcccatacctgggaggcggagtttgcagtgagtggagattgcaccactgcactccagcctgggagatagagtgacactccatctcacaaaaaaaaaaaaaaaaaaaaaaaaaaaaaaggaccagtatagaaatactaatacagtaaaaggtggacttatatataaagaaaataaccaacagattttgtctatggcacaaacttcttagaaattttgaggtctttagccttaaagacctaatcaaatatttattactttgaacagtgagctactgggatatgctgggctttgagcctatgtacaaatctaattttagaagtcaggacgtgttgtaagcaatagcaaagaatatgctagatgatcagcttggcaattgttgaacaaacttcattcagcagtgtgaggacgtaattaaagcagttgaccttcaatctattcactctctttattggcaaatggccgaggaataagactagaaggaagatgaactggtttagtctctttgtcagctgaacttgtggtgaaagagactactgatattttctaggatgaagagatcttatctctgaaataccctttgcaggttgctcctgactgaaacaaattcacagattctttcttctcgctcaattttgctgttgattcttcattttacattctttatttcatttattttatgctttagctctagaattttagtttgggttctattttttcaatctgtctgtggaacttctcaattggtttgtgttttgttttttttcaagttttggttgaattgcctatttattctcttgtaactaattactctcctttaaaacaattatttgacatgaaaaaccttgcaaaaatacaaaaatctataaacttcttgacaaagaattcaaaataattattttaaagaatttctgaatttgcagcaaaagtttgctatagagcaacatgaaagcacagaaaagtatgaaactcattgattaaggtaaatatataaaaaatacagaacactctaatagtgtagtagtggtgtgtaaatcagttttattgctagtatgaagcttaaaatccaaaataataataattatagctacaataatttgttaatagatatagaatattaaaaatatataatgtgacaccaaatatataaaatatagtgggctgagtaaaagtatagagttttgaatatgatcaaacctcagtttaaaatagtttgctccaactacaagatagtatgtataagcttcatgctattcggaaagcaaaaacctatagtagatacccaaaagacaaagagaaatcaaagcatgtcactacagaaaatcataaaatctcaaagaacgacagcaagggagaaataaaggaacaaaaatatgttaaaaggctgaaaagcaatgaacaaaatgtcaattgtatgttcttatctatcaataattaccttgaagataaattcattctattctacattcaaaagccagagtggctgaatggattacaaaaggagacccaacaatatactgcctacaagagactcacttcagcttcaaggacacatatggtgtgaatttaggggatgagaaaatttgatattccatgcaaattaaaacaaaaaaacaacatggataactatccttatatcaggcaaaatataccttaagataaaactctaacaggtgataaagatggtcactatataatgataaagggatgagttgattaaagggatgaaacaattataaataaatatgcacttaacattagagcacttgaaaatgtaaagcaaacattaatatctggagggagagatacagagcaatcaataatactacagatataggtaaccttattgacactgttgaaattatcaatactccaattacaacaatggatagatcatttagacagacaatctgtaaggaaaaaaaaattagacttgatctgcactttagaccaaacggacctaacagatgtatgttcacatttcatccacagccggagaacaggtgttcttttcaagctaacaagaaacatcctctaaaatagagcatacttgaagtcacaaaatgtcttaatacatttaagaagattgaaattttatcaagtatctcttttgaccacaatggtatacaactagaaatcaattaacaggaggaaaactggaaaattcaaaaagaagtgaacataacacaattcttaaaaactggtggtttaaaaaggaaataaaaaggaaaataaagaaatcttgatacaaaaatgaaaacacaatacaccaaagcttgtgggatgcagtaagacagtgctaagatgaaaatttgaaatgacaaacacctacattaaaaaaaacacaaatatttcaaataaacaatctatcattaaacctcaaggaactagaaaaaaagaagagcaaactaagcccaaagttaatagaagaaagaaaataagaaagatcaaagcaaaatagagaaatagagagtagaaaagtaatagaaattgaaagacattctgtgttcatcaatgtgagaaattaatattgtcaaaatgctattacacaaagcaatctacagattcaatgtaatccctatcaaaagtccaatggcatttttccagaaacagaaataaatcctaaaatttgtatgaaattacaaaagactataattacccaaactgatcttgagcaagacgaacaaagtaggaggtaccacacttctcactttcaagttatattactaaactacagtaatatatatatatatatatgatactggtatgaaaacagtcacatagaagaatggagcagaatagaaagcctacaccaatatcgtcaaagaatcttcaataacatgcccaaaacacctaatggagacaggatagtctcttcaataaatagcgttggaattattggaggcccacatgcaaaagaatgaaattggagtgttatgctatgcacaggaataaattgaaaattgaaaaggaatttaaacataacatctgaaaccaaagaatccctagaagaaaacaggggaaatcctccataacattgaccttggcatgatattttggctatgaatcccaatgtatagacaagataaacaaaaataaacacatacaactacatcaaactaaaagattgtggcacagtaaataaataaataaataaataaataaataaaaagtcacccatggaatggtagaatgtacttgaaaacaatatatctgataatgcattaatatctaaaacatataagaaactcataatcagaaaaaaagtaacctgattaaaacatgagcaagagacctgaatagacattttttcaaaggaagatttacacacggccaacacatgaatgaagaggtgcacaaaatcactaaacatgagggaaatataaactggaatcaaaatgagatgtcacattacatctttcaaaatagctaatatcaaaaaggcaaaagataaatagtgttgacaagaatgtgtcgaaaagagaacccttatagagttttggtgggaatgtaaattggtacaaccattatggaatacagcatggacactcctcaaataattaaagatgtaccgtatgttacagaaattatacttttaggcataaaagtatatacctgtgggtgtgttggctcacacctgtaatcccagcactttgagaggtgagggaggcagattacctgaggtcaggagttcacgaccagagtcgccaacatggcaaaaccgcatctctactaaaaaacacagaaattagcccagcgtggtggttggcacctgtaatcccagctacttgggaggctgtggcagggagaattgcttgaacttgggagacagaggttgccatgagtcaagattgcatcactgcactccagcatgggcatcagagtgagactccatctcaaaaaaagggtatataccttttatatacttttccttttatatacgatagaaataaaatcactatcttgaagagatatctgcattcctgtgttcattgcagctttattcacaaaaaccaaaatatggaaacaatctaagtgttgacagatgagtaggtatgtaaattatgatatctatcatctatctgtctatttatctatctatctatctacaacggaatattattccgtatttaaaagaatgaaattctgccatttccaacaaaatgaacgagcctagaggatattatgccaagtgaaataagccaggcagagaatgaaaaatactacaggtacaacaatgaaaacttgccattataagatgaataagttatggaggtctaatgcacaacagggtaaaaatagttagtaataatgtatgctttaagttcactgagtgtagatcttaactattaccctttcccaacacatgataactatgtgaagacatgaatatgttaattagcttgattgtgaaagtccttttaaaatatacttgatgggcgcagggtgagaggagagtgagggtcaaaacactacctgctggggactatgctcactagctgggtgatgaaatcatttgtacaccaaaccccagcaacatgcaattacccacgtaacaaacctgcccatgtacctcctgaacctaaaatagaagttgagaaaagaaaaaaaaagatatcaatttcctataaggagctccaggtttgttccaaacagtagcgagacaaacagatcaaggatgaaatatataaaatagtaggcaaaacgtaaacaacatgtgtaaggcaatcgattctatataactcagcaactcctagggttcttatcaaataaaatcactgatgtgtcataacttctaaactaaaaacaacacaaatgcccattcacagtagaatgaataaataaattacttttgcttcccgcgatgaataccacacagcaattaaacaatgaactgctgctacacaaaacatagatgattctcacaaatttcaactgagtgaaacaagtcagactcaaaagattacatacagcaagtttccatttatatgaaattgaggagtagggaaatccatcgtgatagatttcatgataatgatgaccattggtgagtaactggttgagaaagtgcgagagccaggggtgtgggagctggaaatcgtccatatcttgcttgatttgggtggtggtgatagggatatatacacttataaaaattataatgctatatgcttaagatttatgtattttactatttgtaagatatatattagttgaaaaaatgcttcagtgtaaaggaaaccagtaaaaatacgctacctacaattgtagcttttgtttatcaaaaaagcatttgagtagtctattgattggtaattagcaagtttatgttaagcagccttgtcctgaatactttttagtatgtaccattaagcatttgcctttctcaactagggctaattaaaaaaaactcaaaacctcacattgtacacgttgaatatatataattttaatttgtgaattataccaccataaaactaaaaatctaattaagttgagtttgaatacattttagggaaaatacgataaagaaaattaggagcttaagaatatgcatagataaaaaataaacttgatagaaatattatttatatattatatattatgtatatttatatatatttatatataatatataaataataatatatatataaataatactatatgtatttcagaaaatcatataaaaagctgtgctaaaattttccagagagagagtaaatagttctcctgtagtggattaaaatgagattagcattggagtactagcgtaatacaacagatagagtctgaagtcagatctcaaaaatacaatatatttgctaagtaatgcgagacaagctatttaaagtttttggacctaaatatccagtctgtaagtttgttggaaaaaataaatacgctaatagagaacttaacttacagggagtgctaaattattacctgttactggaaaacataatatcagtgacattaaaagcttgagtgttgtagaacaatattttgaaatatcattttttgaagttatatacatatttatattactttaataatttgcacaacataggaaggaaagcttgctttgcacaggcaacatttttgccaaataatctttaaatcatcatgaattctcaattagattaacaataataaaattttattgtagaagactattttttcattaatatagttgtacatgcacatagggtaaatgtaatattttgttacttgcctaagctttataatgatcaaatcaaagtaaccagggtgtccataatctcaagtattatttccatatgttaagaacatttcaagtcctttagctattttggaatatacaatacattgctgtttatatgtagtcaccttactctgctatgaaatattagaacatatgtcttccaagtaattgtatgtttggacctattaacaaacttttctttattcctcccacccagagaaactttccagcctctggtatctatctataattctattctctacctccatgagatcaatatttttagttttcatgtaagaataaggatatgtgatacttgtttttctgtgcctggcttatttcacccaacacaatgacttccagttccatccatcttgctgtaaatgataaaatctcattcttttttatggacaaaaagtattctactgtgtatatatataccatgttgtttttattcattcatccattgatggacagaggttgatttcatatctttgctattgtgaatattgcaataaatatgagagtgtggttatctctttgatatactcatttatttacctttggacaaatagctagtaataaatagcttgcacctctggtctcagctacttgggagactaaagcaaggggatcacttgagcccccgaggttgaggttgcagtgagccatgatcactccactgcattctagcttggttgacagagtgagaacctctccctcctaaaaaaatccttaagaaatgtgttgatgcctggttcccttggtcagaattttcatttgatgtgttgagagtgtagcacagatgttggaatgaacctctcaagctgattttaatgtgcaaccaagtttgagaaccaccaaggaagagtttttatgaattaagattcctatactctatcctagaactaatacaactgaatctctgggaatggagtatcagaatcagatttgaaaaggtttccttagtaattctaaggactgagcagtttggatactcgtttgttagagtaaaatggttaggtacctagtatcaacataggcacccaacctgatattaataactaggaaaataaagggttggcgcctctgtgtttctttgttgaaaaatctgatactattcttagttctatgaaaacaattgaaaatttggttattatcaccttaaaagtacaaaacctatagatattgaaaatgtaattatttttctataggcatagttgaaatgattttgtaaatgttataaatcagtttctttataagcagttcatttacataaattttgttaaactgacatgattcactaattttctaaatataaatggttcagctctcagttatttttaaactaatgacctgtgttatacttactatttttaatgggcttttatgatgtttttaggtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatggaatagtgtttgcattttttgtttacctggtttaagatgtgcagcagaacataactagatgattacataatttctttttaaggcaattttataatatattttatttatgattataaaaactgcctttaaaaattcttacatggatatcaatgcagtttcactttttttattgtaatcttttttataattattttatacttgtctggcattgagttttattgggcttttggttttttggaagtagggtatttatcccaatttagaaaatttgtatccttgccataatacagtcttccatttttgtacccccaaatctttcatctgtcagaacatcactcaaaggtgaaaatatttcccacataaaattattctgttcctttaatgaaatgagtttcagctgtatataagtaggaaaacttccttttgttctatttgattcctttttacggatactttcttgaggctgtgattacacctttaccttagaggcactgcccaaaaagactcagctcttctgtaaaaatgctgttatgaatcatagcttcttaacttttacaacatagtgaggtagggaaagtaagaacactagagataggaattagaagcatggagaagtgaaccctggagcttcccaatggtgagataccaaatagttcaagaactagtaaagaagactacggaggaatagctagaagctaaatgaagaaagtatctcaaacaggaaggagtgatctgttaatgtgttaggaaagttgagttcttaggattaagcattgggtagagcaagatttgggaccttgactttgacgaacttggtggatgtcaggagtaagaggaggtattcaagagaatgttggagaggaatttaatatagtgagtattgaggacaacacttaaggagtcttgctttcaaggggatgtgagaaatgggttgttaatggagggtaatgtagtatcaaaaagctgtttattttgagatcgatgatatagtaggtttgtatgctaatgggactgattcagtagacagaaaaagcataatgcaggaaacagagggatattgctgaagccatagacctgggacacaaatagaagggttagttttaaagataggcccacaaacagctcattagtaacagcaggatgaagggcagattatggagttccagatgtttgtagtccagtagataggaggagcatgtcaaatttttgtgatattttctcagtgaaacaggaagcaagctcataaagagggaggaagtcacgaaggagtaaggaaggaaaaggagatgtaaaatgaatagataggagtgtaggaaagtaagcatactcttaggaaatctgtggtttatttaagtggtatcagtcaatgtggttctgtgtttttctccagttgagttcagcataggtgctatcactgaaaaagtacagaattcagtttaactaaaggtgagatttctctaggtgaataaaacagtcagtgatgagatgttgatacatttaagagaatgattataaaagagggatgtggaaagtagtctgggttaagtagtgaagtgagaaaataaagaaggttgagacagtggaaaatggaatgatcaattgtagattgcagtgtggttgaagatgcaatggacttcttgaggtgggaactagaaatttgggggatataaataagagaggggtgactgaaattgaaaatatgagagtataatagtatacaatattactaagtatggtatactaagtatagtagaatagtactaagtatagtagaatagtactaagtatatagtacttagtgagtataagttttaggatgtgaagaggggagtagcgtagaggcaaggtgatggaagcagatgagttcaagaaaatgagaacctaggagattgaaaccattatctaaatgaattctgaaatctcaagaagaactgtgctgagtgcttgtagtcattattttgtctttactactctgtgagaagacagcacttccttttgtgagtaatggaaagttctttaatatgtcaactgtaagatactttattacatttaattatctttagtaatgcatagtaataactaatgacctcagtaggattattcagtagatatgtgagctaaccccctgtgtcagacacctaagaggaacaactgatgtttttcaagacgaatagagggttctcatcccagggttttaagctgcaaaatatcccaccctatattttctgaaaacaaacgttatatagagtgtccacataaaagctaacaggaaatattacacacacacacacacacacacacacacacacacacagcattgaaaatgcatcaggaaagatataccctgtacccaacatgcacaaggtctaagcaatgaagaaaatctaggaaatcaaataagaccagaacatctatgactaatatataaatacttgaggcagttatatccatttaaaaggtgtcaattagacatgaaagaaaaaggccaggtgcagtggctcatgcttgtaatcccagcactttgggaggccaacgcaggcggatcaacgtgaggtcaggggtttgagaccagcttggccaacaaggtgagaccccgtctctactaaaaatacaaaaaaaattgctggttatggttgcacgtgcctgtggtcccatctacttaggaggctgaggtaggagaatcatctgaacccagaggtagagattgcagtgagctgagattgcgccattgcactccagcttgggtgatggagtaagattaaaatatatatatatacatttttacataagaaattttattttaatttttttgtaaattagaaaatagcaattaatatggtatttatataccagaatctttgaatatctaaaatttaagaagatgtgagcaatttcatgaaacttttcaaagcttagaaaaaggtagctatgtaaaataacaatgtatgttgtttatgggaacattagatgaagtaagtcatgaaaacatgcatagaaatgatcatataaacttgcaagaaattgaatgtcttgctatcaaaggaaaggatggaggtgtaagagactgaggtagaatgtgagaagctctgtatatattgtattttccttaaaaatatatatttaaactcgcatttcttgtttttcaaatgttcactctaatgaaaattcttttatttttcctgttacagtttttatttctgatctcatatatgcagtgtactgttgttcagaaatatcattgatcctccctgcaaatgaaatactctcatcctgttgaatttgagaatgtacacatgatttgctttggctttgaaatgtgagcagaaagaatgttttactttggggagttcccaattgctaaaccatgtgtcaaaatgaagtttttgtgacattacaaatggactaataagagtgcctttgttgatcctagttgaacatgagaaacttggttattgtaagccactgaaaaattttagtttcttttattactgcagaatagcctattctgtcctgattgatacagccacaacatttccttaagctctttgattttcatattgccattaggatgtagaatgccaagagaaggataaatcataggatcagagaatgttagcagtgaacgagactattggaatacattttttcaatggtttccagactttgggttctaagtaatcagtaatatttcgaaaaagtagtaaaagatatttcaatataaaaaataatgacatttaactttgaaaaaaaaaacctatcattgctaggcataatgggtctagcttgtaatcccaacaacttgggaggctgaggagggaggatcacttaaagtccaggagtttgaggctgcagtgaaccatgattgcatctccacactccagcctgggtgacatagggccacctcaacaacaaccaccaccaaagctatcattaatacattgttcctctgtctctcttcccatcctccttaccacttagtcttaaatctaatcttattaaacaatatctaaggaaaagataagaaaaatgatggttgcatctatactgaacatgtgttgacttttttcttgtcactattttctaaacaacacagtatcacaacttttgacatagcatttatgttgcattagttattataagtaatctgagatgatgtaaaggttatatgcaaatattatattttatataaaggacttgagtaattattactttaagtatccatggtggttcctggaacaaattcctcatggatatggagggaggaggaatcactgtaattaaacaaatcatcactttaaaacttaaaaccttttgcatgttgaatacagtcatgcaccacataaatgatggtggtcccattaagtttattatgccatatttttatcggaagtttcctatgtttaagtgtatttagatacacaagtacactgtgttacagttgcctatagtattcagtaaaataacatgctttacaggtttgtagtctaggagaaataggctaagccatctaggttaatgaagtccattctatgacatttgcacagtggcttaattacctaagggctttctcttcagaacctactcttgtcattaagcaatgcatgactgtagttggacaaaaaataataatgcaggcatacctttggcactgtcctaattcttaccagcatccatgattgcttaaatttgcactggaaagacttcaaaaaacagtgatatattaggacaatatatttccagtacatgacaaatgataacaacataagaactcgaaacactcaataaaaaacaaaaaataaagcaaaactagatgggaaaaggaagaagcaaatttcaagagaaaactcaaaaggccaaaaaatgtgaaatgatgttcagccttgctagtaattgggaaaaacacaaatcattttttttttttttttttttgagatggagtctccctctgtcacccacgctggagtgcattggcgtgatctgggctcactgccagctccacctaccaccttcaggccgccattcccctgcctcaggctccagagtagctgggactacaggggcccaccaccatgcctggctagttttttgtgtttttagtagagacagggtttcaccatgttagccaggatggtctccgtctcctgacctcgtgatctgcccgcctcagcttccgaaagtgctgggattacaggagtgagacacgtgcccgacccaaatcatttttaatctattagtcaaaaattagagctatgataatattaatttttggtgggagtgtggcaaaaggtactataatatactgctactagagagtaaaaattgataaattttgtaagggcaattttgcacaatatgaaaatataaaaatatgcttcatgtttaccatacatttatctagcatacagaattacccatgtgtaaacatgtatacagatgttcattataacacttcttataaaaacaaaatatttggaaataaatgttcatattaataaggcgcataccgtatgatcttagtccagttagaatattctgttttatttcaatcctttaaaagactcaacttctgactctatatagacgattaaaaaaagaatgtgttctccctttgtgcatttggtcaggtaaattaaaaaatacaccacatgctagccgcaccaaactggaataagcctttggaaagaagttgtccttgaagcttgtatctgacattgtagcaggacgagcctcagacaaaacctctcagacactgagttgtagaaggaagggctttattcagctgggagcatcggccagctactgtctcaaaatctgagctcccggagtgcacaatttctgtcctttttaagggctcacaacactaaagatttcacatgaaagggtcgtgattgatttgagcaagcaagggatacgtgacaaggactacattcactgctggtcagggagaaacagaacagggcagggagtttcacagagttcttttatacaatgtctggaatctgtgaataatatcagcttctaaatcataagttgatttttagctactgggtttaggccaatcaggcccaggcctggtttcaggcctggcgctgggctgcatgtctttggttgtacttcctggttgtttttactgaatagaaaacaatataaaacaaggagagggtctttgtctcctctcaatatcagcactggattgtagaatgtgttgctgattttgaccttgtattcaagttaactgttgcccttggtatctgtacatatctttgatttcagtctttactacacgtggcttggtcacttcatggctaaaaacatgcttgtggaagaccagtctggctcggtgagtctgtgcggccagcagtctctgatctgtacagggtattaatgtgtcagggctgagtgttctgggatttgtctagaggctggtaagggcttctggaccacttgtttctgtcctgtcagtctgtcagggttggaaagtccaagccataggacccagtttcctttcttagcttacgttatctaccagagcaccgtgggctgttacttaccttgagttggaaggggttcgcatttatacctgtaaaagtattcatccttttaatttatgtaaagtttttttgtatgccattctggatctttaaagagatgacaacaaattttggttttctactgttatgtgagaacattaggccccagcaacaggtcactgtttaaggaaaaataaaagtgctgccagaacctaagaaaaacattaatatctaaaaggtcatttagatgatttccatgagagactttttgatgttctttacctgttaggattattattgataatccttttcagattatgaataaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtgggtatgattcatagtatcaattgcggaattcactgtgcttgtaggaaatagtattctgatcttatctgtgaagcttgggcaacattttacttcacaggtaagtattctaagtaaaagagatttctgagggaaaatctatgtagtattcttggcaactttatattttgtttctgagataatctttcttcaccaagagccctccaatgtgctgttaatattttcaagagatagctgcctataccaagattcaagaatcttttatactattgattagtttctagaacattcaatgatacacagtaagacagaatttggtacttatgaagactgtttaatttgtaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggtaagtgaattctagtttcctttaaaaataacagacaggaaaatggtttctctctcttctttcttgctccttttcagcagaaaattttccgtattttatttttttaattttacttcataatttaaaactcaaaattaactgtttatttatgttcaacttttgtgaatatttgtgtgtgtgctatctactaaagaggtaagttaaagtttaaatcagaatttgcttctaaagcaaaacatcaaattttaacccttataactgttcgtatttcccggaaacaatttactggttaggaagtataattccagttacaatgtttgctatcatttttaggtgacttgtgtctccatccgtaattcttgggtttttcatggtgaatagctagcttctctatttaatgaggagcataaattgagattaatagctaccttgtttgtcttcaaaagcttcatagagagtacaggctttctcctggtgacccactgaaatttccaaaacaataacctttccactctcatctgagttttgtcttcccaaagtgggctttttgcatttcctcctatttatggtagtttctggtctctcaatttatcattcctataaatatttgaccaagtgtctagaaggcatgtaggtgtttagttcacattactttcctttcacagttgatttttgatcttgtaggaaaataattataagatatcatgaaatattttggagttttattaacatactataaacttgcatcaataatgctttaaatttctacctctctgtaagtcacactgaagtagaaactttgttttctaggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtaatttttttacgagagtgatctgaataaaagagtaatatatgccttttcttgtagacatgtagctaattgaatttcatttaaaataggaatttagatctcttagggacagaagttaacaagtttgactactttaagaaactcaaatccatatttaagaactttcaaatattgatttaagatttttaatcaatacacatttgcccacttctaagaagttcccaattaaaaatctcatcgactttatttcctaaattctctattttctattagaaaatatttcaaagatacatctgtagtagaatgtgagcatccccagtgcccaatgcaaggaagtcactatagaatatctcttgaggaatcatggaataaatgaataatccaatggattctcaggagaaaaatgaggttttatgaatcaatcataacatttttacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacttatatgcctataaaatatcatcttattcgttagaaaattaatggaagatttaattaaaaatgcaatttctgtaggataaggaatgagacatttacataaaacagtgttctttaacctcctcttcttcacatacagcatatctaattctttatcacaacatgttttatggaggtacacagaatgtaggatactgataatagttatgtctttactttctttggataatgaaacaagttaatatttatcaaggaatttcagtcgatactaaatgttttattagtgtgagctcttattattatcattgatgtagaagactaaaaattaggtaagtattttcacaggacaacaggtatctttgacattatgcttctttcaatattgtagcctatactttatcaaataaaagaatataagaatattacctgttgagataataggaataagaaaaccattttgcacatttcgtgtaacaaacaggaccaggcatggtggctcgtgcatgtaatctcagcactttgggaggctgcggcagggggattgcttgaggccaggagtttgggaccatcctggacgacatagcaagaccctgtctctaaaaaacaaaacaaaacaagacaaaaagaaataataaatagcttaatttattaataaataacaaatagcataaagctatttttatataatattaacttattggttaaaatgctttaaagtccttacacaaaatgttattgtttcctaaatttctactaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttccctgaagtatttcatggatctattagtcatactacctcagtgtgacttatcttctggaacattcttattcagacaactatcaaagagtcaattgtgaatgataagtattctagtgccctaaactctaatcaatcatcttttgtatttagagtgtctgtcacaaggcaatatgtctaggaacgctaaacataccctaggagttttcatctaagtacgagatgaatatactggatttgactgatgtttgcatataatcttttaaagccaggttattattaaaatgatcctatcatttatgaagtatgtacaaagtttccatcctgtagaatttacatgtattatatgaattaaaaatataaaaaatatttatattataacaatacagtattgaagccttattttaatctagtttgattaaactagattggtctagtttgattaaactagattaaacttcttggtctaggcacatgaatattgttgtggggaagagaattctgtataatgtgatatggatattgatccttctggagtgcctctaaatgataatgtgctgaaacctctgaaaggaccttttttaataacaaaaatcttatatttgtaatatgaatgtaagtattccatacatgtatatacaaatatggaccatacatgtagattacacatgtgtgtgtgtttgatgtgtgtgtatatatatgtgtgtgtgtgtttgtgtgtgtatatatatatatatctcttacaggaaaagcatttaattagagaaagaatttaatcttcagatgccatgccttacagagagagatgcacagttaagttactctcaaactgttgtgaaatgatacatcaacgtatatcttatttttcaaaaataggaactggggagaaggttggggtttcgtaccttctgacagagcgcttgtctttgtggataaccatgacaatcaacgaggacatggggctggaggagcctctattcttaccttctgggatgctaggtagaaaaccaagttctctatttttttaacacgtcttttaatgatggcaagaatattctgacatcctatgaaaatataattatgtaacttccaggctgtacaaaatggcagttggatttatgcttgctcatccttacggatttacacgagtaatgtcaagctaccgttggccaagacagtttcaaaatggaaacgtaagttttggagttgttcaatatatccttttctgaagaaaaaggaagcaatcttattctaacttaacatgacaactattaattatatatttattcaacaaatatttaattgattgtaaactggatacagggctgtgattttagtaatgtaggttatattaaaggagtaaaatttatattctccattgacaaagagtatgcaagctgtttcagagatatgacaaacatccccttagcccgcagggaaacaaaaaacaaaaaacagaaaaacactcaaaactaagagctagacacagggattaaaatatatacttcgaataagtacctacctcagggctgataggaagattatacatgccaacacttttagagaacttaaaacatcatctgcccgtagtgagaacaatataaatgtttgttaaatacttttaaaaagttatatggaatagaaagaaatgaatcaattgagctgagttaaatagggaaagtatcatataagaggaaggaaatgatatgtactaaagaatagaaatttagagagtattccaagaaaggtaagaatgagaaaaatatttgggagtatggtaaagacattaatctgatgagaagtttcaaaaaggaacagagaaattacagtgtaaagatatttggaaagctagtagaaggttttcttttaaactaaagggttcagaaacagcatcagagacttcagaactaaagcagaaattcctccttcctatgagtcacacggatatctagctagctttttttagattcctttcagtttgagaagtccgcactttgtatagcaatttattctattgttaaacagctttaatatttagaaggtgtacttttatattgagccaacttcttttaatttctactaattggtcttatttctgatgttaggagtcatagagtatttttattttttctattactataacatttccactttgccaggactgctgcatgctaaaaactcttagttttgttcacttttcaccatatgacatgattctaaggtcaacactgaaaaacttcctaagattcctctggattttttaatgaagattttttaaagtgccaatcagaaaaccataatatgaaaaatgtggtcaatttataaataatgttcagatgtattgttttgtacatttatctaaaaagaagcatgaatgattctaatatttattcagcacatgtcacattcaaggcattttcacatatattacttaatttttatagcaaaaaaaccaatattcccattttacaaatgaagaaactgagacacagagatattaagtgtattgattaaattttctcaggtactagtaatagagcctatgttttaatcctggtgtttctagtactaatgcccttcccatttcaatgacattgcatggcttaccacgatgttaagaagctcttgcaggccaggtgcagtggctcacacctgtaatcccagcacctagtgaggcgaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgatcatgccactgtactccagcctgggtgacagagcaaagaagcctttgcagttctttggaatgaaaaggagaggataaaaatttgttaccttgtttgaaatatgccagaagaaaaccagaggatagagagatgatgaagacccagtaaagggctataaacattaatgaaggcattggattctagataaagtcactgaatgcagagacacaagtaacaggattggttgggtttggtgtaaaggagaaggaagaggtaaatacatgcatagtaaaatttggctttttcccccctacttaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccactgcattttatttaaaacagttgaagtttaagaatatcaacgttttatatggtattgtgtttttaggaacatggttattttccgcaatgtagtggatggccagccttttacaaattggtatgataatgggagcaaccaagtggcttttgggagaggaaacagaggattcattgttttcaacaatgatgactggtaagtaaatatcaattaaaaataatattttgtaccagtatgttcttggtttattcttttttttctctgttcattgacttttatcatatctgaaaaatcatgtagtcagtggagcaagaagacaatagagatcaaaattgggcagaagcaaaaggatgatggctgttactccttcgttctttttttttcataagtgctttctgttgtaagcagaatcctttctgtgcacccttgcagtatcatatgcatatatatgatgcacatgcatatgctcacctacacatgccacaaaatcaatatataaaatcacaatcaatataaggattgtgaaatcattaaaaaaaagtgtcttataatcctgcttttttaaccatggagaaatgctgcctaggtactaaaatatctttatttctaactctttttctcaatgactgctctacgtagttttttggtacactttcttcacttctctgtctccttgtgacaaataacatttttaaagcacatgtatgaataatatgtatcttgtggttactgttttgcttcaggagatttgagttttatttttgaaacttctcattattggcctttcatctgtgattcttatatgctttacctgaagcataaatgattatctaagatatagctcagaagaccttggtgtaaacagttgaattgtccctgtccaagaccaactgacactcatacttagctcactctagtataaattatatttcactgatgaaaagtaaataaatacatcaatatacaagtcaagttgatctctttcctgccaaaaaagcccatgtctagttttttaatttctttcttttgtagatgaaaataccaaaataagtttttgtgaaaaagctttatatttcaaactatcacttcttcatagaaatgctagattatttttatgtgcatcccaaattcgttttgatctcatgggagaagaaggaggttaaaaaataataccctttaaatttttaagagtaattggtattaatttcagttgagaacaaatttgattttaccaaggtagaacttttatcaaagtgtgaccgttcctgccaatcttcagtgatattcttcaactttgatgttttggtaatattttcactactaaccaggaaattgctaggttttctgtaaggttacttttggtcctagaaagctatttccacctactagagaggcatatgggttttcttcttaataagacttcactgcttaggtttgtttctacaacataaagttatgctgtttatttgtgttagtctgtattcttgattttcattgtattgaagatcaaccttaaattttattttacaggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaatagccaagtgtgtttcttttcttacatgtacagcagtacttatatttcattaatttttactaaaagctctaattagtaattagaggttcaaaaaagttgatagtgtgaaacacaattccaggttacacagaagttatttattttggcaaaaggatgtctcagaaattttaaaactaggcaacaacctttactcattaagagggaagacttagctttccaaacagtctgtctcctgtctactcttttctctccttggcagtctaccaacaaggcaaaccaaatatttcattattcttctctattacatgaaaaatctgtacaagggaaagaaaaccaaattttacccttacattggtttcaaaacattcctttttccataggcaacgtttacatttttatgcctttttataatcttttatgacaaacacattttactgtttttacacacattttacacactttgcatgtaaatttatttttagttgtcttatttacatgttttaatggtaaatcttaactttgccattttagttaaaatggtaactttaatgtaaaacctggtaagttttttcaattatgtactagatgcagataaagtctgactttttccatcctagttaggggcatggttaatttcatatgtccccaggccttatcaagttgtaaagtaggcagtatacaaccttgaaacatttagcaaacctggtatctaacttatatgatttaaacctcctatttacgtgttgatgatatttgcattttccaatttgatctttaaaacaatttttatttcttagagatgaaagtcacataaactaaaaggcattgcagttttaactttcctctaaaatgtttgatttaagtgcatatttttatttcaggcaatcagttatagctcgttacagacatcacacacaacacatatatcattacacagacaaacagaagcagatccagtagttctaagatttcttcctgtcccacttcctaattgaattattggcttcccagtagagccctttaagagcagggatagaaaaaccatgaagtttctagggcctaatcaacttgtatagctgtaagacaaaagcagattttgagtgggatctatcagcctctaaattctgggattccatcaggaaaacagaggtttctcccaaaatggaatccactgtgccttttctgtttttcccaaaaagtttcaggccaccagacattaccttgggtgcatcaagagtggaaagacagagcggaggacagtaattcagccaacagaaaaattcttttcaagaaaaacacaatccaagaagagaaaaacatacgggccttttaaatatacctataacttgaatatccacttttaatcaagctgagcactctttcagaaattcctttgaaatcttctgttacctgactttagctaaatcaagcaggtaatatttctggcttttgaactttactaaaagtaacatcacaggtgaaaacaacaactctcaatcaggttataagttaactgtgagtattcaagatattttataagtggtggtaagcagcttttactagatctagaaactttaaaggcaatttagagaaaggaagatttcagaaaggaaattagagttgttcatggaggaggaagagatgattaaaggtcatacagctattaaattgaaagtattcatcacccaagctaggattgaacctgggccaccattgtaaaatggcaatggctaaaaaagtcctgccacaaggttacaggttatgctcaagacataaaacaagatagaggcatgcagcaaagtttgttacttaccagtttatgtgggtgacttgaatagtgagcttatggagtcccaggcctggattccattccaacgtattccaacccgttccaagatgggttgttacccatgcagaaaacggggggaatataaggtgtcccttagtctcctttctccttttgaagtgacccaggatgaagcaaaagattacaggggtgtccctgttctcctctttcctcccatctcctttgggtcccggtaaccatcataggtgctgtccatggatgaaagcatgaattgcacccatggatgtggaggtgctagctggcaggagtagtcatttttaccagcacaatgcctcctcacactgctcttctgggttcctaggcctcccaggagattctacagtagataaagttgggtgagacactttaatagagggagtgttttaaccctattcctgcctcctctagttatggacctggaaaagcagtgcattcccagaaaattttatccattgacatttaaatataaaatcccctttctgtttaaatgccaatgtggttggaagcagaacaggtgtctcaaaagaacatatagatttaatggctgtcctccttctgatggaaacagcactaaggctagaatttgtctctcaagggtggcttcctcccaactgttgaatgcggagtttttttccttagaaatggggcatagggtctgcttgctgttagaggaacacaaaagagggagaaatctgggcattagaattttttggcgaacggccaccaagaatttttacggagaaaaatagcctatctcatgaggtggtgctgtagggtctgaaaagttatgtaaaatctgtgactctaaattttttccaggaagaagttagaaagagaggtttggggtttaacaggctgtcactgtatatgcctcccagcagtagaaaattaacttgtctcattaataaactgttcaaattcattcagcagtgctgagcttttacatgaaggaaaagcaactgaaatggagagggatgagggtattcacttggggtgaaatatcttctcatagagtgccatgaatgactgctattgcgggacaagaagcacttactaggtgaaggtttagactgaaatcttgaaatcccctggtattttgtgtgtctgattacctttccaaaggaataaaatcagatatgtatccatctcagtgagcagaggggtgactttgagtagaatgggaggaaggtttgttctaagtagtttcccgcttgcattttccccagtgatttcaggggcccagtatattttcctttcacacatctgacaagggattaataaccagaatatctacggagctcaaacaactctagagggaaaaaaaatctaataattgcatcaaaaagtgagcaaaagatttgaatagacatttctcaaaagcagacagacatatggtaaacaagcatatgaaaatgtgctcaacatcattgatcagagaaatacaaataaaaactacaatgagatattatctcaccccagttaaaatggcttttatttaaaaaacagacaataacaaatgctggtgaggaggtggagaaaagggaaccatcatacactttttgtggttatgtaaattagtacagctgctatggaaaacaatttggaggttcatcaaaaaactaaaaatagagctatgatgtgatccaggaatcccacagctaggtatatacccaaaagtaagaaaatcagtatattgaaatgataactgcactcccatgtttattccagccctgttcacaatagctaagacttggaaactacctaaatgtccatcaacatatgaatggataaagaagatgtggtacatatatacaatagagtactattcagccatggaaaaatgagatcctgtcatttgcaacaacatagatggaactgaactgtacattattatgtgacgtaaaataaaccggcccagaaagacaaacatcacatgttctcacttatttgtgggagcagcaattccaaacaatggaactcacggtcatagagagtagaaagatggttactagaggctgagaagggtggatgggaagcaagtgtgaatgttcaatgagtacaaaaaacagaagaatgaataagacctaatatttgacagcacaacagggtgactatcgtcaataacaacttaattgtacaatttaaaataactaaaagaatataattagattgtttgtaacataaaggtaaatgctcgtggtgatggataacccatttaccctgatgctattactacacattatctgcctgtatcaaaatatgacatatgccctataagtatatacacctcctaggtaccaacaacaattaaaaatttaaaaaagtgtatccttcccagtgaaccgaaatattttacattgatcatttttacattatcatagtgtgttggaataatcatagctttggaaagaaaaaaaataaatgtaaactttcaaagatggcaggagatatagatctctctttctttagtggatttaaatatgcaatttgttatcaacattgcactgacaatttttaacacaggccatattctggaaatgatatgattataggagttataggaaaaagcattttttcatactgtgattatctaggctatgaggaaaagagatatttcctctatgatgtctaatttagcataattattctttttaaactatatttagatttaattaagagatacacaaacaaattacttttagtagtaagaagagtttttaaaatgttttgtgtaagatgactatgtagtaaagaaggttacaaacctgctttttaacttagaaaaataatctcaccttcttgccccatggaaaattgaaatgttatgtggaacccaatgtacaaaaactctcagtgaggatttctgtcttaagtttcaacggattgaggtgagatcagtgcctgttccacctttttcctccctgtcctaggtgacttgataacatttatacagccataaaattttgcttttaaattcaagtatagaaaataaactttaaaatgtgatatttttatatattttaccttaataatttatatgggaaatatttttgaaaggttaaaaaattaaaatttttaaaagagtatagtgaaataatctaatcacatgtggaaattgtgttactatttccccaagcattttttgtacatgtaattgaaaatgagttgaatgtaactcataagtagtataaaagtgtttaatatttaattttctgctgcagtaatgtgacataacaaccttaaattcttggtactttaaacaagatattttttttctcccaaatttctaggttatttaagggcagttctgcttcatattgcagtttgcctgggctttactccaggctgtgtgttggagttaggtctaatctattgtatccctacacatcccacttagaaaagctaacaaatttcctttggacttcagtcagttcgattgtatttgtcattcaaaagccaaatcatttatcctaacaccaacggcttatttatttatttatttgtttgtttatttatttatgttttagaaggagtttttctcttgttgcccaggctgaggtgcaatggcgcgatcctggctcaccgcaatgtccccttcccgggtcaagggattgtcctgactcagcgtcctgagtagctgggattacaggcatgcaccaccatgcccagttaattttgtatttttagtagagatggggtttcttcgtgtggatcattctgttctagaactcccgacctcagttgatccgccagcctcaggctcccaaagtgctgggattacaggcgtaagccaccgctcccagcctaaccgattgcttcttttgttctgtagtcttttgccaaaactgttattctctggactcactttcaccttctctcacacatacatgtccctcgtgtccctttgtgtctccagggtcttctatttccacgtaatcttaatttttcatcacatcctggactcatgagtaattaatctgttattctccctgaaagtgcagccttgttgaatagaatgtgttctttaaacagcagctttgtttctcgagtgaggtattaacttccagatttaggtgaaaatgagttccaagttttatgtttcattgtgtgtctaagactgacaccgtttattaccgtggcacttacagcttgctttcaatgcctccaaattctctatctgaaaggctgggtaccatatctcatgtctgaacatagtcctcagaatcatgcagtaccagctatgttccttctgtatattatggcttccgaggtgcctgttaagcagccaggtgaaattgccttttaatcaatataggaaccagtctctttcctggtgatgctaatgctttttataaaaaggccatgctgtattgaagttcttctttcaggacaaaaccactaatggaactcatctacctactgatgggtggaagctcttggtatgccaaagtcttgttttgtttgtgaagaatctctttccctcaacagtgatgtgctacgttaggtctcaaatcattgttgcgttttaatccaaatttatgacaaagattttcagtttgtatgcataatttccttctctggccttaaccatcagtctgtggacttgccaagcaacaacaacaacaagaacaacaagtctgaggtcaagagacactatttagatctcagaatcatttgttgtcatttatcctttgataaagttttgcctttctttctttatgagtatatttcctctcatggtttcccaatctcttgagaaaaagaaagttcttgcctcttgcagtctttctcattagttgaattataccagcagttcagcttctgatcctgtcgagaaatccaccatgaagaaataaaacatttctgattacatggattacgtttcctggattcttataggcattaaacttagttctaggatacaaccgcatgatcttctcttattctcagaacaagaaatatattactatatacattacagtttgtatatattgcagtttatatagagtatatgtatatgtactgtatatatatatgtacacatatatataacagtaaaccctgtaggcaagcaggaaaacttcagaattctcaatgaatccatcattagctgttagtaatgacaacactattagaagtatttcaataatcaaacattgttgtggtctgtatgtgcacccccaaaagtaatatcttgaaattctaacacctgagggcatagtatttggaacttgggagtggaattcttttttgtgctattatgaataagatgcttgcctcttccatcaaatgaggacacagccacaagttaccctctaggagctaggaagttagtcttcaccagacacaaaatctgcttgattttgaatttagtctcctgaactgtggaaaataaatttctgcttttataagccactcagtttatgctatttggttatagtggcccaaagagagtaaaaagacacattatttacctcctttgtggactctctggagttgttgctttaaacttgctttagtgcctaacactgctccaactccctgtcctttagcacacacggataaataattctgctgggaactgacatgtttcactcaggcatccaaatgtatttattatgttgtcaaaatatatagcacttgttacaatgtttccatgttagacatattttgagatatatgccttaacactgtgctgtgattattattaatatctagtaactaatcttaccatatctaaactcaaagttttcacgataacactgccttattagggactgaattttttaaagtatgaagatcttacatcaagtccaaattgattcatctgatagtctcgcagtaaaatcaacgccacagaattatctattctgtttcttgtcttgttgtagctgatattctgtgattggacatattgctaatatctattaaccttagcataaaatgtcatattgaaattgaagaggaatattggaacttggctaagaaagattgcttttcagacacagtgagaactaaaatggaccctctgttcctggaggtatattttacaaaaattgggtgctattataggaattctgtacaattctatcttatgcacttgtgttccatcagtgtcaatcctctctgtattttaaattgactatgatttctttttccatctttctgtttgtcaagtattcttttgctgaaaatttgttattcatgttccaacagaaaatagattttttttcttttaactcattggaaagaatatttagagtctttagtgacaaatgacatggtataaatgaaaagaaaatactgacattgtacttgagaaatactaattaattgggagaatattaattaaaagacattgtttaaatatttctatcacaaattgacagcagaacaatacacaccaccagcaaggtataatagtagatatgagaggtaaaatgattaattagatattgcattttctccagaaaacttattatttagtggaaactggccaataatttcttaggccttaggataattttacctttgattctctagttaatcaaaaatatataaaaatattaaccaaaagtatatatttttaaaatacctacataatctaatgcagtatgtttcgctctcttcttgaagtgaattaaattccttatcactgaccataaaatttaactacatagatgattcttgtttaaaatagttaaaagtgaacgtaaagatcagttttggttttccttttcttacccccgttttttacacttatatttgcctgtgtcattcatatacttttagaatccaaaacaataattaaaaacataatcatttggttttcaaaagctttttgcatctctagaaagttaatatagagtcttataaaacttttagctaattcaaaaacaaatcacacatatataattgaagcaaactttgtttggtagacttcttcgaaccacagaaatttcagttatggcatggtaggtcttttgaaatgtttcattttttatatttggagatgcacaacaaaagtctttccactccaactcccctttaataaaaacagaatgtaacaaaaatatcaaaatctgtaggaaaataacccattcgtctatgttaaagctatgagatttccagcccaaataaattataagaaccagtatagaggccgggcgcgatggctcacacttgtaatcccaacacttttgggggctgaggcaggcggatcaagagttcaggagatcaggaccatcccagctaacacggtgaaaccccatctctactaaatatacaaaaaaagtaattagccaggcacagtggcgggtgcctgtagtcccactactcaggaggctgaggcaggagaatggcctcatcctgggaggtggagtttgcagtgagccgagatcacaccactgcactccagcctgggagatagagtgacactctgtctccaaaaaaaaaaaaaaaaaaagcatgtagaaatactaatacagtgaaatctggactgatatataaagaaaataaccaacagattttgtctatggcacaaaattcttagaaattttgagatctttagccttatagacctaacaaaatatttattagtttgaacagtgaggtactgggatatgctgggctttgaggctatacgcaaatctaattttagaagtcaggaactgttgtaagcaatagcaaagaatatgtttgatgatcagcttggcaattgttgaacaagcttcattcagcactgtgaggatgtaattaaagcagttgccctgcaatctattcactctcttcactggcgaatggcccaggcataagactagaaggaagatgaactggtttagtctctttgtcagctgaaattttggtgaaagagactactgatatttttctaggatgaagggatcttatctctgaaataccctttgcaggttattcctggctgaaacaaatgcacagatcctttcttcttgatcaattttgctgtcgattctcattttacattctttatttcatttattttattctttagctccagaatttttgtttgggttccattttttccatctctctgttgaacttctcatttggtttgtgttttgtttttttcaagttttagttgaattgcctatttgtcctcttgtaactcattactttcctttaaaacaattatttgacaggaaaaactgcacaaaaatagaaaaatctataaatcacatgacgaagaattcaaaataattattttaaagaatttctgaatttgcagcaaaagtttgctatagagcaacatgaaagcacagaaaagtatgaaactcattgattaaggtaaatatataaaaaatgcagaacatgctaatagtataatagtggtgtgtaaatctcttttattgctagtatgaaggttaaaataccaaagtaataataattatagctacaataatttgttaatagatacagaatattaaaaatatataatgtgacatcaaatatataaaatatggtgggctgagtaaaagtatagggttttgaatatgatcaaagttatcagtttaaaagagtttgctccaattacaagatagtatatataagcatcatgctaatcaaaaagacaaaacctatggtagatacccaaaagataaagagaaatcaaaccatgtcagtacagaaaatcatgaaatctcaaagaaagacagcaagggagaaataaagaaactaataatatgttaaaaagccaaaaaacaatgaacaaagtggcaattgtatgttcttacctatcaataattaccttgaaggtaaattcattctattctacattcaaaacccagaatggctgaatggattacaaaagaagacccatcaatatgctgcctacaagagactcacttcagcttcaaggacacatatggagtgaatgtaggggatgagaaaatttgatattccatgcaaattaaaaccagaaaacagcatggatagctatccttatatcaggcaaaatatactttaagatacaactgtagcaagtgataaagatggtcattaaataatgaaaaagtggtgagttgattaaagggatgaaacaattataaataaatatgcacttaacattgaagcacctgaaaatataaagcaaacattaatatctggagggacagatacacagcaatcaataatattagggaaataggtaaccttattgatactgttgcaattatcaatactccaattgcaacaatggatagatcatttagatagacaatctataaggaaaaaaaacattagacttgatctgcactttagaccaaacggacctaacagatgtatgttcacatttcatctacagctggagaacaggtgttcttctcaagctaacaagaaacatcctccaaaatagagcatatttgaaattacaaaatgtcttaatacatttaagaagattgaagttgtatcaagtatcttttttaaccacaatggtatataactagaaatcagcaacaggaggaaaactggaaaattcaaaaataagtgaacataatgcaatccttaacaaaaagtgttttaaaaaggaaatgaaaaggaaaataaaaaatcttgatacaaaaatgaaaacacaatactccaaaacttgtggcatgcagtaagaccgtgctaagaagaaaatttgtatgacaaacacctacattaaagaaaaaacatctcaaataatctatcattaaacctcaaggaactagataaaaagaagagcaaactaagcccaaagctaatacaagaaagcaaagaaatatcaaagcaaaataaagaaatagacagtagaaaaataatagaaattgaaagactttctgtgttcatcaatgggagaaatcaatactgtcaaaatgctattggacaaaacaatctacagataaatgtaatccctatcaaatgtccagcggcatttttcacagaaacagaaataaatactaaaatttgtatgaaattacaaaagactataagtacctaaagtgatcttgtgcaagaagaacaaacaggaggtaccacacttctcactttcaagttatattacaaaactacagcaaattttatatatactgacatgaaaacagtgacatagaagaatggaacagaatagaaagcctagaaataaacctacaccaagacggtcaaaaaatcttcaataacatgcccaaaatacctaatggagacaggatagtctcttcaataaatagcgtttagaaaaactgcaggcccacatgcaaaataatgaaatttgacagttataatatgcacaggaataaattgaacattgaaaaggaatttaaacttaacatctgaaaccaaagaatccctagaagaaaccaggggaaatcctccttaagattgaccttggcatgattttttggctatgaatctcaaaatatagacaagacaaacaaaaataaacacatggaactacaccaaagtaagaggttgctgcacagtaaaaaaaaaaataataattaattaattaattaattaattaaaaaggtcacccatggaatggtagaaaatacttgaaaacaatatatctgataatggattaatatctgaaacagataagaaactaataatcagaaaaaaatcctgattagaacatgagcaagagacctgaacagacttttttccaaggtagacttgcacatggccaacacatgaatgaagaggtgcacaaaatcactaaacaagtgggaaatataaactgaaatgaaaatgagatgtcacattacatcttttaaaatggccaatataaaaagccaaaagatagatagtgttgacaaggatgtatcaaaacgagaatgcttatagagttttggtgggaatgtaaattggtacaaccattatggaatacagcatggagggtcctcaaataattaaagacttaccatatgatgcagcaattatacttttaggtataaatttatatacctgtgggtgtgttggctcacacctgtaattccagcactttgagaagctgaggcaggcagattacatgaggtcaggagttcaagaccagagttgccaacatggcgaatccctgtctctactaaaaaccataaaaattagccaggtgtggtggtgggcacctgtaatcccagctacttgggaggctgcggcatggagaattgtttgaacctgggaagcagaggttccagtgagccgagaacttgatgccattttatataattatcctttcacagacaaaagaaatctaatcactatcttgaagagatatctgcattcctgtgttcattgcagcattattcccaaaacccaaaatatggaaacaacctaagtgttgatagatgagtagtatgtgaattgtgatatctatcatctatctatctatctatctatctatctatctatctatctatctacaatggaatatcattcagtattaaaaagaatgaaatttggccctttgtaacaaaatgaatgaccctagaggatattatgctaagtgaaataagccaggcagagaaagaaaaatactacaggtacaaccatgcaaacttgccattataagatgaataagttagggagatctaacgtacaacatggtaacaatagataataataatgtatgctttaagttcatggagtgtagatcttaagtattatcctttcccaacatgtgataactatgtgaagacatgaatatgttaattagcttgatagtgaaaatcattttaatatatacttgatgggcgcagggtgagaggagagtgagggtcaaaacactacctgctggggactatgctcactagctgggtgatgaaatcatttgtacaccaaaccccagcaacatgcaattacccacgtaacaaacctgcacatgtacctcctgaacctaaaatagaagttgagaaaagaaaaagaagatatcagtttcctatagggagctccaggtttgttccaaacagtagagagacaaacctatcaaggatgaaatatatacaagagtaggcacaacttaaacaatgtgtgtaaggcaatcaattctatataactcagcaactcctaggcttcttatcaaataaaatcactgatgtgtcataacttctaaactaaaaacaacacaaatgcccattcacagtagaatgaataaataaattacttttgcttcccacaggggaatacggcacagcaatgaaacaatgatctgctgctacacaaaatgtagatgattcttacaaacttcaactgagtgaaagaagtcagactcaaaagaatacagatagcaactttccatttatatgaaattgaggagcagggaaatccatcgtgatagagttcatgataatgatgacctttggtgagtaactggttgagaaagtgcaagagagtggttgtgggagctggaaatactccatatcttgcttgatttgagtgatgatggggatatatacacttataaaaattataatgctatatgcttaagatttatgtattttactatttgtaagatatatattagttgaaaaaatgctgcagtgtaaaggaaaccagtaaaaatatgctacctagaattgtagatttgtttaacaaaaaagcatttgagtagtctattgattattagttagcaagtttatattaagcatcattgtcctgaatactttttagtatgtaccagtaagtgtttgcctttctcaactagggctaattaaaaaaaactcaaaacctcatgttgtacacattgaatatatataattttaacttgtgaattataccaccataaaactaaaaatctaattaaaatgagttcgaataaattttagggaaaataggataatgaaaattatgagcttaagaatatgcatagataaaaaataaactgttgatagaaattttattgttatatttcagaaaatcatataaaaagctgtgctaaaagtttccagagagagagtacatagttctcctgcagtggattaaaatgagattagcattggagtactagtctaaaaccacagatagagtctggagtcagatctcagaaatacaatatatttgataagtaatgagagacaagttatttaaatttttgggacctaaacatccagtctgtaagtttgttgaaaaaaataaacaggctaaagagaccttaatttacagggagggctaaattattacctattattgtaaaacataatagcagtgacattaaaagcttgagtgctgtagaacaatatattgaaaatcactttttgaagttatatacatatttatattactttaataatttgcacaatgtaggaagaaaagcttgctttgcacaggcaacattttgccaaataatctccaaatcatcatgaattctcaattagtcagattaacaataataaaattttattgtagaggaggattattttttcattaatatatttgtacctacacatagtgtatatgtaatattttgttacctgcctggactttacaatgatcaattcaaagtatccggggtgtccataacctcaagtattatttccatatgttaagaaagtttcaagtcctttagctattttggaaaatacaatacattgctgtttatatgtagtcaccttactctgctatgaaatattagaacttatgtcttccaagtaactgtatgtttggacccattaacaaacttttctttattcctcccacccacagaaactctttccagcctctggtatctatgtattattctattctctacctccatgagatcaatatttttagctttcacgttctattcttagaataagaacatgtgatgcttgtctttctgtgcctggcttatttcacctaacacaatgacttccagttccaaccgtcttgctgtaaatgataaaatttcattcttttttatggacaaaaactcttccactgcttgtatatataccacgttgcttttattcattcatccattgatggacacaggttgatttcatatctttgctattgtgaatagtgcaataaatatgagagtgtggttaactctttgatatactcatttattttcctttggatacatagctagtaataaatagcttgcacctctggtctcagctacttgggagactaaggcaagaggattacttgagcccccgaggtttagattgcagtgagccgtgatcacaccactgcgttccagcctgggtgacagagtgagaccctctccctcctcaaaaaatccttaagaaatatgttgatgcctggttcccttattcagaattttcatttgatgtgttgagagtgtagcacagaagttggaataaacctctcaaactgattttgatgtgcaaccaaggtcgggaaccaccaaggaagagtttttatgcataaagattcctatactctatcctagaactaatacatatgaatctctgggaatggagtataagactcggatttgaaaaggtgtccttagttattctaaggactgagcagtttggatactggtttgttagagtaaaatggttaggtacctagtatcaacctagccatctaaccttatattaacaactaggaaaataaagggttggagcctctgtgtttctttgctgaaaaatctgctgctattcttagttctatgaaaacaaattcaaaattcggttattatcaccttaaaagtacaaaacctatagatattgaaaatgcaattatttttctacaggcatagttaaaatgagtttgtatatattataaatcagtttctttataagtcatttatttagataaattttgttatactgacatgattcactaattttctaaatataaatggttcagctctcagttatttttaaactaaagagctgtgttatacttattatttctaattggcttttatgatgttttaggtttcttttgaatcccgtgtccttcaagtgctttccaactttgagaagaagaaattgaccacccggactatggaactgtgcgtaacagctttgaaagtgtatttaaaaattaaatctgtatgcctttaaatcagtgaattggaaatatattacatgtattttaatgactttcctcaaatacaataaattgttttctttccaatggaatggtgtttgtattttttctttacctggtttaacacatgtaggagaacataactagatgattacatcaaattctttttaaggcaattttataatatattttatttatgattacaaaaactgccttttaaaagttcttgcctggatatgaatgcagtttcacattttttaaattgtaatcttgctttttgtaattattttatatttgtctggcttcgagttttattgggttttagttttttggaagtgggggatttatcccaatttagaaatttgtatccttgccgtaatacagtctaccatttttgttctcccagatctttcatctgtcagaacatcactcaaaggtgaaaatatttcccacataaaattattcttttcctttagtgaaattagttccagctgtatatacgtaggaaaacattcttctttttattcgattcattcctataggtacgttcctgggtctgtgattacacctttaccttagaggcactgcccaaaaagactcaagtcttgtgtaaaaatgctgttgtggatcatagcttcctaccttttacagcatcgtgaggcagggagagtaagaacattagagacaggaattagaggcatggagaaatgaaccctggagcatcccaatggtgagatataaaatagttcaagaactattaaagaagactaaggaggaatagctagaagctaaatgaagaaagtatctcaaataggaaggagtgatcaaatattttagctgtgttgatgagttaggaaagatgagtttttggattaagcactgggtagagcaacctttgggacattgacgttgaccaacttggtggatatcaggagtaagaggaggtactcaagagaatgttggagaggaatttaatatagtgagtattgaagacaacacttaaggagtcttgctttcaaggggatgtgagaaatgggttgttaatggagggtaatatagcatcaaaaagctgtttattttaagatcgatgatatagcaggtttctatgctaatgggactgattcagtagacagaaaaagcataatgcaggaaacagagggatattgatgaagacatagacctggtaaaaaaatagaaggcttggttttaaagataggcacacaaacagctaattactaacagtaggatgtacgtcagattatggaggtccagatgtttgtagttcagtagataggaggagcatgtcaaatttttgtgatattttctcagtgaaataggaagcaagctcataaaaagggaagaaatcacgaaggattaaggaaggaaaaagagatgtaaaatgaatagctaggaatgtacaaaagtaaacaaactcttggcaatctgtggtttatttaagtggtattagtcaatgtggtttcgtgttcttttccagttcagttcagcagaggcgctatcactgaataagtacagaattcagtttaactaaaggtgagatttctctaggtgaataaaacagtcagtgatgagatgttcatacatttaggagaatgattataaaagagggatatggaaagtaatctgggttaaggagtgaagtgagaaaataaagaaggttgagacagtggaaaatggtatcatcaattgtagattgcagtgtggttgacgatgcaatggagttctcgaggtaggaactagaaatttgggagatttagataagagtgggttgattgaaattggaagtattagaggataatagtatataatagtactaagtatagtatactaagtatagtagcatagtgctaagtatatactatcttgtgagtataagttttaggatgtgaagatgggggtagcatagaggcaaagtgatggaaggagatgagttaaaggaattgagaacctaggagactgaaaggattatctaaatgaattttgaaatctcaacaagagctgtgctgagtgcttgtagtcattattttatgtttactactctgtgagaagacagcacttccttttgtgagtaatggaaagttctttcatgtgtcaattgtaagatactttattaggttcaattatctttagtaatgcatactaaaaaatagtgagctcagtgggattattcagtagatatgtgagctaaccccctctgtcagacacctaagaggtagaactgatggtcttcaagaggaatagagacttctcatcctaagtgtgtaagctgtgaaatatcccaccctatgttttctgaaaacaaacgttatatagagtgtccacataaaagctaacaggaaatctcacacacacacagacacacacacacacacacacacacacaaaacattgaaaaacttcaggaaagatataccctgtacccaacatgaacgaggtcaaagcaatgaagaaaaagctaggaaatcaaataagtctagaacaactgtgactaatatataaagatttgaggtggttatatccatttaaatggtatcaattagaaaggaaaaaaagaggccaggcacagtggctcatttctgtaacgccagtactttgggaggccaacacaggcaaatcaacctgtggtcaggggttagagacaagcctggccaacacggtgagaccccgtctctactaaaaatacaaaaatatttgctggacttggtgtcgcgtgcctgtgctcccagctgcttgggaggctgaggcaggagaattgttttgacccagaaggggagattgcagtgagctgagattgcgccattgcattccagcctgggtgatggagtaacatccaaaaaaaggtattttacataagaaattttattttatttttctgtaaattataaaatagcacttaatatggaatttatataccagaatctttgaatatccaaaatttaagatgagagcaattttgagaaacttttcaaagcttaggaaaaggtaactacataaaacaccattatgtgttatttatgggtacattagatgaagtaagtcacaaaaacacgcatagaaatgatcatataaacttgcaagaaattgaatgtcttgctattgaaggaaaggttgaggtgtaagagattgaggttgagtgtgagaagctctgtatatattgtatttttcttaaaaatatatatttaaactcacatttcttgtttttcaaatgttcactccaatgaaaattcttttacttttcctgttagaatttttatttccactctcacatatgcagtgtactattgttcagaaatattagtgatcctccttgcaaatgaatactcccatcctgctgattttcagaaggtccaagtgatttgctttggctgtgaaatgtaagcagaaagagtgttattttggggacttcccgattgcaaaacaacatagtatcgcaacttttgacatagcatttacgttgcattagtcattataagtaatctgagatgatgtaaaggttatatggaaatactacattttatataaaggactcgagtagttattgctttaagtatccatggtgggtcctggaaccaattcctcatggatatggaggcacaaggaaccactgtagttaaacaaataatcactttaaaacttaaaaccttttgcatggtgagtacagtcatgcaccgcatatatgatggtggtatagttaagtttattatgccatacatttattggaagtttcctatgtttaaatgtattgagatacacagctacactgctttacagttgcctatagtattcagtaaaataacatgctttacaggtttgtagcctaggaggaataggctatgcaatctaggttaatgaagtccattctgtgatatttgcacagtggcttaattacctaagggctttgtcttcagaacatactcctgtcattaaggaatgcatgagtgtagttggacaaaaaataataatgcaggcatacctttggcactgtcctaattcttaccaacatccatgattgcttaaatttgcactggaaagacttcaaaaaacagtgatatattaggacagtatatttccaatacatgacaaatgataacaacataagaactcaaaacattcaataagaaagaacataacaattaaagcaaaactagatgggaaaaggaagaagcaaatttcaagagaaaactcaaaaggccaaaaagtgtgaaatgatgttcagccttgctagtaattgggaaaaacacaaatctctttttttttttttttttttttttgagagggagtcaccctctgtcgccaacactggagtgcattggggcgatctgggctcactgcaagctctgcctcccaagttcacaccaccattctcctgcctcagcctccaaagtagctgggactacaggggcccgccaccatgcctggttaattttttgtgtttttcgtagagacagggtttcaccatgttagccaggatggtctccatctcctgacctcgtgatctgcctgcctcaacttcccaatgttctgggattacagctgtgagccaccgtgtctggcccaaatcatttttaatctattaggcaaaaattagagctatgataatattcatttttggtgggagtgtggcaaaaggtactataacagaatgctactagagagtaaactttgatacatttgtaagggcaattttgcataatatgaaaatttaaaaatatgcttccagtttcacatacgtttatctagcatacagaattacccatgtgtaaacatgtatacagatgttcattataacacttcttataaaaacaaaatatttgcaaatattcatatgaacaagtgcatacatatgatcttagtccagttagaattttctgttttatttcaatcctttaaaagactcaacttctgattctatataaacaattcaaaaaagaatgtgttttccctatgtgcatttggtcaggtaaattaaaaaatacacctcatgctagcctcacaaaactggaataagccttgggaaagaagttgtccttgaagcttgtatctgacattgtagcaggacgagccgcagaaaaaacctctcagacactgagttgtagaaggaagggctttattcagctgggagcattagccagctactgtctctaaatctgagctcctggagtgcacaatttctgtcctttttaagggctcacaacactaaagatttcacatgaaagctttgtgattgatttgagcaagcgaggtatacatgacaaggactacttgccccggtggtcagggagaaacagaatatggaagagagtttcacaatgttcttctacacaatatctggaatctgtgaatcacatcggcttctaaatcataagtggatgttcaactactgggtttaggccaaccaggcccaggtctgtttttgggcctggcgccgggctgcctgtctttggttttatttccttgttgtttttactgaatagaaaacaatgtaaaacaagaggagagggtctttctcctctctcattttctttctttgagactttcactcatttttattagtgggagctgtcacttttatgatttatgttcttctgtgcaatagattgatagccatttatattgtatgcttgtgctgaaggcttttggtgaaataagggagagacgaagttttttatgatttggagaaacacaggtatcagacaagggagcagtaagcaggttcctattactattattacctctattataagagttttaaatcctcctattgctgggaactactttctaaacatggctcctggattgagtctgtgccagccttgcacgagtacatgtgccagttttgttatatccttaagtatatgctcaactacttgttctttatcatctatgtgtaggcaacatgtttcgtcagattctctcgccaggcaagaacagtcaaggcttgttgggttttattagtaataatttctaaagcagcttgtaaccatatgagcatgtagataggggttggatatcctcatgagccatcttgtacttaagtggcgggtccatagtattgtatgattctttcaggggtgcattcatcatctttctaaccacttatggctatgcttcattttgcctgggaagcatagactgggaagcctacaagttcaactgtttttatgggcagtaagaagaaagatggcttcatggtgccaattacacagccacacgcccactggtcaggcagcttagcataagctttgtgtctacatatctagcataacctagtgggggccgtccagtcctggtggaattctggatgggcctaaacagtctgcaactttggaaatttgctgaatgcatttctttctgtgtaattggaactgtaccatgtaactgtttttgtggcaccattatacaggttttgcctaagacaaataagccgccttacgggatgagtaaatccttttctttctctagctacgcattactgtctaataattgtgacttttagaaactaaaaattgtcggggttgttcttttgggatggaattcgtgaggaactccatctgtaggaactaattcttgggcttcttatggccattgatctcctgttacagtccttccacaaacatcacatgaaatgacttgtagagactgggctacatgtttggctaattgcaaaaacaaatttttagtttttttcagaaatttcaggtataggcacattgaattcatcatagaaagtgtgaaatacttgtcctggtgagcgtttttgaacttcttcttttatcaggatgcttacactagaatctagtccttttctatcaatgcctaatgttatatattttcttttattccactttggatctgaggggtttgtgatgatcaattttaaagggttgcagctcccacttgtgcaagaggggctgacttttcttttttggagccaaacaggatcttttttatctttcttctaagtagcctaactgacgcaataccactattgacacatcgaacataaatatggttcttgacagatgtacttattttctgtgtgtaatttttcccaaatttagagaaatgcatcttatcctctgctgtttagtattaatagtggcacgagcatcaaattttaaagttacatttgtggggactcttctttcttctgttctagctatcactttacttgtgttacttagagaaggaccagttcttagtcttacttcgaagactgtgatcatgggggtttagaggggtcatagcacacatcgggctggtcacttcctggattacatacttagtactgggtgttattatacaaacaggttctgtttggagttcttaggcattcataatagctgtaaaataaaacgatcatcttaacttgtccttcttcagtgtcctgatgtatgcactgaaggcagtcctctgtgtgggaagaggtagtggaagcttttaccacacaggtccatgttataaggacaataagtcctacgacgattttcctcatgctttggccatgtgtagtctagtcagcttcgtggtgtgattggagcagggcttgtcattttcttcaaggtcacttttcagggattgtccaagtttggtttggcctcctaggtctcagcggctgcaggcttcatgaggctgtggtgaatctaggctgggattccttctacattgacagctgtgggagtggtcaggttaattgtctggggtcctttccactgtggccacagcggagccacgttccagtccttgatccacacaatgtcacctggagaaaaagggtgaactggggagaatcagctgcctgggcacctctcatttactcaagttgagatagtctgagtaattttccctaaggcctgtagctgccgctgtaatgcaatctcacctaactcttggggagtacctggaagccctcccagtatgggaggaggcctatgatacagaatttcaaagggggagtatgctgttctcttagaaggggtacacttaattttaaacaatactataggaaggacttgtgtctattttaaatttgtttcttgacatactttccagaaactttttctgatagttcgattcatttgctgcactttccggaactctaaggttggtaaacggcatgtaacttctatgaaattcttaatacctttgccgtcttctgtatcaagtcagcaacaaatgctggcctattatttgagccaattcgtagaggcagtccaaacctagggatgaaattttgaagaagtacacaggttacttcaggagctttttcagttcatgttggataagcctccacctacttagagtaagtaaacactagaaccagtaaatacttgttacttctacatttaggcatttctgtgaagtccacttgaagatcttcaaaatgagctgctccagaggcttctattccccgaggtacagaggggccttgcttcgcattgtgctgtccacaggtaaggcatcactgcgctactgttgtagcaacagctggcaagggtgagatgtagaaatactggcctaacagcttttcaagtgattcttggcctcaatgggtagtttcacatacagtcagcatgactgtatagcagcggtggcactgctattcttccatctggtaactttatgtatctttcctttattgtttgtcctctctctgtctgaaaaaattctttttcctctttagaataagttggcaccagatcaagcatttgaaggagtagcagggctgtgactgatgtctggtaaggagtagatgctgcttttcctgcctctgtgtctgctcagggctttccttggcaaaccgaagcggaaactcgctgatatcccctgcaatgcatgaatgccaccttttggggtttctacactgcttctaatcattgtagaatttcttgctgacattttatgtcttttcctctagaattttttccttatacaatgctccacatacttgaagggttagaaaggcatatcaagaatcagtatagatgtttacaatcttaggttcactgagttccagagcccgagttagaggaatgagttctgctttttgggctgaagtgctctgaggcaatggcttagcttcaacaacatcatctaagtttactactgcatatcctgcacacctttctctttgcgggttgatgaagctgcttctgtccatgtagaactcctaatctaccaatgcctatggctggtctcaaagatctggtctgctagaatagacatagtccaacacctctacacagttatgtttaacagggctgtctgatactgggagcaaagtggcaggatttaaagaattacagacttctatggttatacattgattttcacataacaagctttggtgtttagttaatgtagcatttgttagccaatggtgtcttttggtgttccttagagttacattagagtcagcttgggctgacataagtttttcttttaacttataagtcttgttgttgtagagacctctatttaaaaggctctcggtcaccccctttataactccattcaatgctttggctaacaccacaaagtttggaatctgcagtctgcaaaaatctcacagctcctaaatgttctcttatttgcctcctggttttaggttctggtaagctgcagatgacctgctttcttgctgaccatagactgcactccccttttcaaatagtgaatcctaggtagtgtacctgctgtctgcagatctgagctttctttttgggcactttatatccacagtcctccaggtgtcgaagcagggcacccgtcctttttgcacacctgactgccatggagtgtcctagcagaaggtcatctacatactggagcaggatgcaacctaggtctttagcaggaaacatttggaggtctccaaccgaggcctccccaaagatggtgggggactttttgaacctttgggaaagtcgagtctaagtgtactgaatggtgacatctgactccggatcttcctactgaaaggcaaacagcttttggctctcaggaactagcctgatgtgaagaaggcatctttcaagtcctgtacgggtcgatagtctttggtccttggtttagggacaggtaggaggtgggtgttccatggagactggcaaggaactagaattccagaggcttttaagcatataagatgagtctctattcctttaaaggcttccctgggaacaggatacggcttttgtccaattggctaggtcgtaggctaaacttctatgagtacgggggcttgattgattgccagcctcagaggattgtcctccatctctactcagagccgtcactcagctggagccacttttatttcctgagctggctcagttagcaaaagtctccactcttcttcctgggggactggaagggccatgatgactcctgtttctggcaactccagctgtaaagtgccttgttttgtcaaggaaatggtggctcttaacttgctaagcaagtctcttctcaacaaaggcaagggacagtcagacatatacagaaatggataaatcactttgtgtcctcccactgagcagttgcgcggtagacagaagtcctgcttggtagagactcctgttgctctaattctatcaatggtctttatagatgagggggccactggagtgcttactactgagtgttcggctcttgtatccactaaaaacttaatgtccttgccccttattgtcatcctgaccatgggctccttgggggcatttgagcctgttccccttaattctagcagcccctcagctagattgaacaaaatcctttcatcttggtttgaggtctttggctctgcatcactctgattttctttgagttggggacatttatctttctaatgtcctatttctttacagtaggcacattagtcatgctgcaaatgtgagtgattggacagggcattcctcccagaacccccttttttctgccttttcaggagaattcctctaattgtcacagccagcaaactagcgtttcacctggcctggcgttcgccctccttacggctttcttggccgcttgttgcatctctatttacaaatacttcattagctctttccagtaactgcaaggttttcattcctgcaaacctagcctgtttttgcaattttctctggatatcttctgcactctgaataactaaggccgtattaatcaacggctgattttcaggactctccagatcgaaaggagtgtacatgcaataggcctcacacggtctttgatagaactgggctgggctttcctcctttccttggatgacttcagaaactttatttacattggtacccttttgagccccttttttcaacctttcaattaatgcctctcggtaccctcttagcctttccatatctggtccttcatttggatcctattgagggtccgttcctggcagctgaattcttatgtattcttggggactttgataattggctgggatgtgctcctccagccatttaactgttgcctgcagcacctgttgccttttatgtgttttaaagaggtacatgagtagctggtggcaatcagcctaagtaggattctgagtctggataattctttgaagcaagtcaattagggcttgaggcttttcagtgtaagatggagtgttatttttccagttgagtagttcagcagaggtaaaagggtgatacacaaaagcatgcctttctaccgtatgtctgacctcatctgtcctagtatatcgctgctctctcagggcatttgaattcccgtcttgggccgttaagcgggctgccagggaagtggattttcccgcagtttcacttttgttcttgtctactctgggtggtctaggggctgtgggctcaggagaagggggcctccccactggataaggggttgagggcactgttggtgccatctcctgccttgagtcctcgagctctgggtcaaacagaactttaggtgctggcttctcttggccggtggagcgagaactttcctgaaataaatgtccctttgctactactactgctgctgcctgtccttttaccactgtagaggatctaaaactagctgtaactaggaatctctatatggaaattgatatgggtgcaggcacaccatgagcgatcaggccaagcttccgctcaggtggagtggggcaagttgaaaagacttgtcttactaagtttcagatgtctggactccaagtgccagttccttcctggtgttcagccactgtgttaatcctccgcggggatcactgctctggcgaggcgttcaaccggggccatttcctacctgggagcgctctttggatcccatccctcaggctggccagagtccctggcagcctgagggatgccccggccttactccacaaggcatgcctaatctgcctaaggagctgcctcggccgtccatcagttatcttgcttccaggtcagggaaccaagaaatgtagcaggacaagcggcagacaaaactctcagacaccgagttgtagaaggaagggtgttattcacctgggagcatcggatagctactgtctcaaaatccgagctccccaagtgcacaatttctgtcccttttaagggcacacaacactaaagatgtcacatgaaagggtcgtgattgatttgaacaagccagggatatgcgacaaggactacatgcacccgtggtcagggagaaacagaatatggaagggagtttcacaatgttcttctatacaatgtctggaatctatgaataacatcggcttctaaatcataagttgatttgtaactactgggtttaggccaaccaggcccaggcctggttttgtgcctttgattttgcttccttgttgtttttactgaatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaatagctaagtgtgtttcttttcttacatatacagtaatagttacatatcattaattttaaataaaagctctaattagtaaaaagaggtttaagacacttgatagtatgaaatacaattccaggttacacataagttatttattttggcaaaaggatgactcaaaaattttaaaactaggcaacaatctttactcattaagaggtaagacttagctttccaaacagtttgtctcctgtctactcttttctctccttggcattctaccaacaaggcaaaccaaatatttcattattcttctctattacatgaaaaatctgtacaagggaaggaaagccaaattttacccttacataggtttcaaaagaatcctttttccataggcaacatttacatttttatgcctttttataatcttttaccacaaacacatttaagtgttcctacacaccttgcatgtaaatttatttttagttgtcttatttacatatttttatggtcaatcttagcaatttttaactttaatgtaaacctggtaagttgttttaattatgtactagatgcagataaagtctgactttttccattctagttagggcatggttaatttcatatgtccccaggccttaccaagttgtaaagtaggcagcctacaaccttgaaatatttagcaagccttttatctaatttatgtgatttaaacctgctatttacatattgatgatatttgcattttccaatttgatctttaaaacagtttttatttcttagagtttaaaaacacataaactaaaaggcattacggttttaactttcctctaaaatatttgatttaagtgcttatttttatttaaggcaatcaattggtcctcgttacagacatcacacacaacacatatattgctacacagacaaacagaagaagatccagtagctctaagatttcttctcgtcccatttcctaattgcattactggcttcccagtagagccctttaagaacagggatagcaaaccacgaagtttctagggcctaatcaacttgtatagctgtaagacaaaaacagattttgagcaggattgatcagcctctagattctgggattccatgaggaaaacagaggtttctcccaaaatggaatccatcatgcattttctgtttttcccaaaacgtttcaggccaccagaagttatcttgtgtgcattaagagtggaaagacagagtggagaacagtaattcagtcaatggaaaagttcttttcaagaaaaacacgatccaagaagacaaaaacatgcaggtcttttaaatatacctataacttgaatatccacttttaatcaagctcagcaccctttcagaaaatcctttgacatcttctgtttcctgactttagctaaatcaagcaggtaatatttctggcttttgaattttaccaaaggtaacatcacaggggaaactaaaaactctccgttaggttataagttcaccgttagtatacaagatattttataagtggtggtaagcagcttttaccagatctagaacctttaaagtcagttgagagaaaggaagatttcagaaaggcagttagagtttttcatggcggagcacgagatgattaaacgtcacacagttgttaactggaaagtattcatcacccaggctgggattgaacctgggtcaccattgtaaaaaggcaacggctgaaaagtggtactaccacatggttacaggttatgcttaaggacataaaacaagtcggagacatgcagcaaagtttgttactgaccagtttatgagggtgtcttgaacagtgagctcaaggagtctcaggcctggattccattccaaggtaccctctgtctgactttttcttctattttctctccttttcctgagcctcctcctagtacgtcttatgaaagactgaggtggctactcttagaaggttttctaaggtgccttctagtcctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagagttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatattgattaaaaatcttaaatcaatatttgaaagttcttaaatatggatttgagtttcttaaagtagtcaaacttgttaacttctgtccctaagagatctaaattcctattttaaatgaaattcaattagctacatgtctacaagaaaaggcatatattactcttttattcagatcactctcgtaaaaaaattacctgagtagcatcattgtagttctcgatatctccacttccagttttacatttaccatcattgaaatcccatccagaatatgggactgctggaaagtccctacttccagggttgaagtaacttccacaggtactgcttgttcctgcactcacagcgttaccacacatatgattaattacagcatccacataaatacgaacctagaaaacaaagtttctacttcagtgtgacttacagagaggtagaaatttaaagcattattgatgcaagtttatagtatgttaataaaactccaaaatatttcatg

SEQ ID NO: 132 - DNA, 111067 bp, Homo sapiens
tataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatgattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaacaatagccaagtgtgtttcttttcttacatatacagtaatacttatatttcattaatttttagtaaaagctctaattagtaatcaacttgtaaaattcacaaaaaaaccaatagtattaaaatcccacttaattgttgaataagtgtaagataataatagtcagcaagttgttatgctttagaagactgactttaacctatttaagctatgaactcagaaaagcatctcaaccaatatgtttgttgccattagcatcatttaccgagctgtgtacctttaatttctgccattctataatccttccaaggagtgtttttatcagttagttagggatagctggtttaatgctgattcccatgcaaagttagcccggttgtatgctttttataatatgcaagtacttctggtgttaataaggttaaaaaatagaagaaacctaaattatacaatctacagttatcagttctattgagctcactggaatcttctcctactttatagacttccttctttttcatttttttcctaattgcttagacttgttgtatatgactttttgttctttttcttattctacaatctggatatttatttagggctttcatgacaccttgtagtctgggttttcttcccaattctctacctattcattcttcttcatcttgactttacatatggaattcattagggctctcatctaggtttccttataactctcagttgttttgtttatgcttaaatgagaacatagaggccataactcagaaactgtctattcttcacctataaattgtccctgccacaaagcagattcactgtgcattggtaccacttcggctcactgcatcttgggctgcagtttctactacttaagattgagtccagtgatttagaacatacacacaaaaagttgcatgaagcaggcttattgcttatagataggcatcaagtgacacagaagcccggcgttcaggaggagccagcctcccaagactcagaccgtttgcccagggtgttgaagactcatttgcacatgccctatttgtaccacagctgagggacccttgaaagaagcctgccccgtgttttataacccaggcatcccatgatacactgggctaaagcacttaaggaaatgttctaagaggcacagtaagagagtctgagacttatctcaggatgttgcattcccagctcattctacagctattcttgagatgcacaagttatagaggaggaaaacctgggttgctccaaggccacttggagagttgtcctgcatttcctctagcattttccttttttttctcctattacaataaagaaagtacatgtcattctaagaaaggccattttctctgcttaagttaatgataccattccatttttatcttttggaggactttagattatcctccctcttttgatttagcagtctttccctttcttctgcattagtcatcctagattacatgtattacagtcttccaattaaaaacatcaatgaccatcctcagatattcttctgggtatattactttgctcatttccttgctccctctcctaattaaacatctctttttatcacactgtctccacatcctcagcctccgtcattattcatctctctactgtccagttttcaccattatcacttcattcagtctgctcttgtcaacatcatgagtgacatttatgttaccagtccaatatatttctctgtcctcaccttaaaccacttcatagcagtattaatgatggtgggtcactttctctttctatcttccttttttcgtgttattctactctcctggttgccttctgtctcattgattgctctgtttcaggtttttgtttttttttttatcttattcttaggtggatcatcttattctgttccacctaagtcctaacttttatctatttctcttctttatcttctcttctctaggtgattggaatcatttccatggattttaaacaaatattttctgtggacacctaggtatcttcaattcagaacttggacttcagcctcatacttccatcagatgcttgttatcaccacttccatgttccacagacatctcataattaacatatttaaaatggaaccctcattttttttccttgcataaaccttttactacattattttcttactgcttagaaacccaggatattttctgatttatctctcttagctcaacaactttatctcttcatataaaccttagcatgaactattaattgtatcttcaaaatatctcttcatttattgcacttcttttgtatcttctatcacccctttatccagctcacaattatctgttctctgcattccaaaacaactctgcaactggtctcctatttccattattttactgtctccctttattttactaaagaccacaacattatattcatacaatttaaatccaattaaaatgttaatgcttaaaactcttaaatttttattgcattcagaataattctaaccactcatggtagcctacaaaatcacaccttatcagacatgaacctcagttctattcttttcccttgacaatcccatagccttaggtattctggtctttcgtcattttattaaatatgccatgtatttttattttatgttgtggactttttgtatgtgtttctccactcttttggaatcctcttaactgagttcttagcatggttggctcctgtttttataagtactcccaaacacaggaactagcattaccattttttcagtcctgcagttcagaaatctggggcttacgtttgaaaccctcttctcttacatttcccagaacaaataaagcactgaatactttagatttttgcattctatttcttcactatattattttctctttctacttctactatctagtaacccttttcttcaatgaccaaaatctattttacttccagcaatatggtgaaaagactatcgactcttaatttaaagccagactttattgtttataacaaatgcattgcagaatgtaaacagagaatgtaatcacaagccaggggctgggagcacttcatattagtttcttaacatgtcagaaccacattctttcatttttataagagagtaaccagagagccactttaagaatttttagtggttagcagaggagtagaggagagtgcccttgatacacaggtagtggtgaacatgtatctttacccccagcaggagagaaaagataaacattagagacataagctagcaagcttcaaaaaggatatttgaaaggggttttgtaatgggatatcagtttttgtacaagggaatttatttgtacaagaggttacggagcttttctcggagaataaaacaagcctgtctattacttgaaattttaacttttagaatagcttacgtgcacttatgctgattattgaggggttgactgcagcatcagcgtccacttcagtcctttctccaaccattccattatctaccatgcgatcagagtgatcttttcaaatcagataaccaccaccacttaccttaggataaaaagccaaaattcttatcagggcttgtaaccctgtgcttgaagtcttacctcactcaattctcctctttaatttctgatctctaaccatgctaatcttttagttactgcaactcaacaagatctttttagttctttaatttcaattcaagagacattctgctctttctgcttggaatgctcttttcttacctcttctcctaattaactcctgttcatcattcaaatcttaattcaaatgctgatcctgcatgaatatttattcagtattaggtcaagtcccctgatgactgttagcaatctctgtacttcttatcactcagcatagtactgtgggaaatatctgcattgttctttattgaatccttagtctcaggacattatccagaatgtcttacgaagagatcaataattatttgtaaaatgaattgagataataataaaagagaaaaataagagaaaaaatgtatctatttttgagaaggagaacatttttaatgaagatgtggccctggaatacagatgtttctctcatttttttcctatttcttcccaaatttaattaatttctggttaaccctgatttctcagatcataaaaatcatggggaaatcaactactttggcaataacccatcatgttttcaggatttgtaagccataacaacagtaaattctttggtgagctatactctcagtaagtaaatgaagaataattcaaatattattgggaaaatgatgccacattcatctgaatataataaatgtgaaattcattttactatgttcttagaactttgtaatactaatttataatagcagtttcatcctttagatatttcattttatctacggatctaattcttcctgtgaaattactgagctatttctctattcttagaagagaaaataactctttgtgataaaaatcattactatgtataattagacttccgtttacaagtcaaactgaaccaacgaacttacaatcatagaatgtgactagtcacagggaatggttggggcattagctcagtacctgtccaaagtgagctcattattatgattattagtatcaccattatcaatcagcttccacataaagtgtacctaaatgctagatctatatgatagcttccaaaatgacactgatttttaataatccaaatctttaaagagatcactttccattttagaaaaatgagatttttttttttttggaaaagatagaaaaacctctaagcattttaaccaagggttttagaacactttatttttatgaatatatcaaagcaaattccttctttattttgaaagtgactggaaacaatttcacggtcttactaagggctagtttaagtgagtctcaatttttcttctgttttgtttgctcttacaactttcctcacacacacacacacacaaagggagatataaaaaaatctagatataacagatgcaacttacaattttttggtaagaaatcataaagttttagaaaaaatcatttaggagtgtcaataaaaacgatatttaagaaaacagtaggaaaagtgatatattaaaagacttttaaacacctttcacaagaaattgaacagatgtgcaaatacacattatacgttatctatttgctcattttatcctgtccttaaacataaactttgaagataaaagaaagaagtgtggctcagggtcactcatgtaatctgtttttaggcagaaacaggtgtgttgaaaggtttttaggtaaaacaaccaccacttagacttcaataaagtagtatttattattttcctataattgcaaatttaccaaatgtaactcactattttttctttaatattttcaaagatatttttgagtaattattatattttcacaatcaattcagtagacatttttgaaaaacttatctgaacctagttttctcatctgtgaaatggaaacaatatatactctctcagtttgttgtgtcaaatgagaaaccatatatgatatactaaccactggttctggctaaatgcatacctcctcatcttttcagtaaagacatgactgttggccaggcacggtggctcacgcctgtcataccagcattttgggaggctgaggcgggcgaatcacttgatgtcaggagttcaagaccagccggaccaacatggcaataccccatctctgctaaaaatactaaaattagccgggagtggtggtgcatgctggtagtcccagtcccagctactcgggaggctgaggcaggagaatggcttgaatggcgctgggagattgcagtgagccaagatcatgccactgcactccagccttggcaacagagtaagactccatcccaaaaaaaaaaaaaaaaaaaaaaaagtaactgttattctcagtactttgggccagcacagtactgatactctcctaaaatctaactcaaagagaaaaatcacaaagcattggaattggagcagaaagtaatgtattcttgtttgacatctttccacattcagtctgtgtactgttagctgaaagctagttgacacaaaatgctgtcttaactttagtgttgtttctaatttagttctaggtcataaaatttgtaggaaagtctaattccaaaactttatcaacagctttgttacgctcaggtattatgatcagatatcttatgtgtgctctatgacctcaagcaaagattaaataaatctgtacattacagtgaagacccacatcaaccaatgcaacatacatttatttttcgcagcactcttttaggtgctttgaaacatgtaacccatgtttaagtgcagaggatagctggcaaggcaaaatataactatatgatgtgttaataagaatacagaggaatagttaaagtgatgcataataaagtacggaaatatgttgtttgatttcaaaggaaggggatagtacatatgctgaaatggcctgggaaagcttaatgataaggaaggtcttgagatgggtaagagagatttgtaaggaagagaaaggagggaaatttattccaaaagaagaaaaagtatgacaaaagcacaaaggaataaatgagatgaatggcagaaaatagatcagttaatcagtgaggctagagaagcacgtttatggaacactagtgaaaaatatgatgaaaaggtagaatgtgaccaataacagaaggatccattttctatcaagactttcttattagatttgatatgttcataccagcaatgtcatctctgaatataaaagatatctgtacttacgcaacataattatatgttatcactgggaaattctaggaagtaattatcagtccctttattaatattactatagaattaacttattcagttatagggtacactacgtttatagtttacttccttcctcccccagcctccagctttgtaatttaaatgaaactaaattccatcataattcactcactaacacataggactgccaacctctgaatggctttagatttgcgtgaacctgtatttgtcaatgcttgctccaggattctattggcatatgtcgaaataattgatttttatgacaacctgcttcctgcttactgttttttaccatagggagggaaaaaatagaattatcccttgatttagctgtcagtcaaatgacaactcaagcatgctataaaattaaagaaagccccacattctaccaggaactgatgattttagtgatactgctctctttgtagaagaaataaagtattttcatatcttatgatgaatatcactataatacattaaaatatagaattgcatccagcaaaatatcctgaagtggacaaaatatgcccctccaaaatatgccatttttgcacaataatttttttgagcagaaagcaattagctcactgactttcacctttctaaaagcaagacataaatttcaatttgtaaagacgtctccctttagtgtacttgtaagaaaactactccatagacaactcttaatagctgatgacttatctgcataagaaactttattaaacaatcctgatttagaatacatttcttcccccactttcccgtaacttacctcctgcaccgagcagccctaaacttcttttctttggctagtctaagatatacaccccaaatcctaattgcctctttgcatcacatttctttgtgaatttccatgtgtatgtacataattaattgttatttttcttgttaacttgtctgtgatcagtttaatttgtagggtcccagacactgaacctaggatggaagagaaaaagtgtttctgctttcctatggcttaggcaaccatgaatggacaggcagggcatcccacttgctccagaggctgcagctcaattgagatctgacaaagctgatgtgaaaactttactgaaccagatcctggaattttgcctacaaaaatacaaatacagaactctgttttttcttttccaaattcagatttgcacgagaataaaattataagaattagttctttggaatgtgattctggtgaattttctcctgagtatcattggttattgaccctttcactcccagggagagccattgctttcctgtgtgtctcattttgtgtcttgagcgcttggattcactttcttcctggtggcagggtccacattgttgggcttgctgtacaggcagtcagtcatcagattgtatgccctgagaatttgtagatggtcagatagagatgcaggttgcactgtcttgctactgatgttctaccaaccctctcagagggtttgtctaaatttttatttcttttggctattgctgggaggaactccatatcataaggacttcatttttgcactctctttgtggatacctcttacgttcttggctatctacattattaaatatgttttttccctctcttattaatcttttatttatttaaaagtggtgggttcccatggccttgggcatctctgcctctgtggcttcacagggtatagcctcatcctagctgctttccccggctggtgttgagtgtctgcagcttttccaggtgcagggacaagctgtcggggaatctaccattctgggatctggaggaaggtggccctcttctcacagctccactaggtggtgccccagcagggatcctgtgtgtgtgctctgaccccatatttcccttctttactgacctatgagagtttctccatgaaggccccgccactgcagcaaacttctgcctggacatctgggtgtttccatatgtcctgtgaaatctagggggaggttcccaaacctcaattcttgacttttgtgcacctccagctcaataatacatggaaaatgccaaggactggggctaccaccctctgaggcaatagcctgagctgttccatggccccttttagccatggctgaaggggctgggatgaggagcaccaagttactaggctgcacacagctcaggggtcctatgcccagccgaagaaatcactttttcctcccaggcctctgggcctgtgataggagagtcggctgtgaagacccctgacatgccctggagacattttccccattgcctttgagtttaacatttggctcctcgttacttattcagagttctgcagctggcttgaatttcttctcagaaaaagagatttgccttttcaatcatatcaggctgcacattttccaaactcttatgctctgtttcccattttaaaactgaatgctttaacaatattcaagttacctcttgaatgctttgctgcttagaaacttcttctgccagatacactaaatcatctccctcaagttcaacagttcacaaatctctagggtaggggcaaaatgccactagtctctttgctaaaacataagaagagtcacctttgctccagttcccaacaagttcctcatctttatctgagaccacctcagcctggattttatatcattattgacattttactcaaagccattaacaagtctctagggagttccaaaccttcccacactttcctgtattcttctgagacctccaaactgttccagtctctgtctgttacagagtcccaaagtcacttacacatttttgtgtatcgttttagcagcacttcactcctggtaccaatttaccgtattagtccattttcttgccgctgataaagacatacccaagactgggaaatttagaagagaaagagatttattggatttacagttccacgtgcctggggaggcctcacaattatggcagaaggtaaaaggcatgtctcacagggcagtagacaggagaacagagcttgtgcagagaacatccccttttttaaaccatcagatcttgtgagattattaactaccccgagaacagaacagcatgggaaaacctgccaccatggttcaattatctcccattgggtccctcccacaacatgttgaaattaaaattgggatttgggtggggacacagccaaaccacatcattggggatggaactttttattgtgagtatgtctgcacaagttacctgtgtagattttcttgtctgtgtggctgtgggaatgtcttagtcaaacacccctatgcaagtttacttatctatgactatagtttgattttttaggctgttcttttgtttgaatgaattcaactgagtacccaccctaactgcctgcctgactggtttgtttatttctcctctctcatttttacccacgggagtggagagcctaactgctgttagcgaggtggggtgatgctcgctacttcctgctggaaaggggcattgtatggggaacagcagctagggttccttctgtgagctttctaagggtccttggaagaaatttgtgtccatgcatggtttcatttgcatcaacatttgtagtttgatagactttaggcaagaaaaaaaaatggattattagaggacatgtataaaaatgaaacaaggggataggtaatgaaagctcaaaaatctcaaggcttcagccatgcccagataaatagtggctatagttatgcctactaagatttgggtgcatggggctttgctttggtgaacttccttggttttattttcccaaacaaagaaacctctgggttatgggtaccctgtatactcccataacctggtaggatttgcaggataatagcccaaaactagaatattgattcagatttttacactacttattccttttttattttgagttgcagccagagattgctggtttgtttacaggaataagcagagttattctaaaatgtacgtgatatggtttggctttgtccccacccaagtctcttctcgaattgtagctcccataattcccatgtgttgtgggagggatctgtgcgagataattgaatcatgatgggtgtttttccccatactgttctcatggtagtgaataagtctcaggagatctgatggtattataggaggaaatccctttcatttggttttcatcctctttcttgtctacttccaagtttttgccttccatcatgattgtgaggcctccctaaccatgtgaaattgtgagtccattaaacatcctttttaaaataaattacccagtgtcagatgtgtctttgctagaagcatgagaacagactaatagagtaggcaaaacttaaaaacaactaatgagattagaatttaatgacaagtgtatgataagttttgaatcaaattttgctctctccagtcctcatttttgttcaaaacaaatcatgatagtcattttgttaaaaacaaattacgactgagttgtttgcaatgtaaacttaggctcatacttggcttgattatttgcataatgtgcagcaaaaataattatttttgcagtcttttaaaataagctttgatggaactctgttccacaagagatctcagataggacttttttaaagccaagcccggccatgagtttgtaccctcaaatacctatgagttgagtgaattcctctcttcttaatgtcacaagaatatgtggttcctgggactgttatatagtgacattctttactcatcacagattagaaaccccgtacacagattatgtagacaaggtaggaggccacatttcccaatgggcttttattggctctgtaagtgaagcttgattcctcaaagagaagcatatccatccaatcaaagccttggtaaaacaaccagtttctccaattgtgtcatgttgcaaaagaaaatgaattcttactgcactggtgcaaacaacgatattgccataagtttagaatattcccaaatagtttccaaattctggagtaacttggcagagagaaacaaatacgctccaaattttgttcactggtgtataccttacttaattcttaaaagctgtagatagcttaaaagaaaggtttccttaactctgaagaacaaaacaaagaacagcaatgttttaagcaaaaagtaaaaaaagattatttcagacttctattagtttagttcatgcagttaactcctgtctgatattcataaacagttaagatcttcatgactcttgtatgatttcttttattctcatgtcatgatttccaaagttatcagaaacctgcatttgagagcacattgtaaagtcctacagctgattgtaaaacatcttttgaagaggattaaaacaagacaacatttatctgtagatgacatagtgttcaggttagttacagtgaaaaacatgactggcaaagatatttggttatttctgtggtttgcaataacttaatacaataatcctaattatgatccatagcatattctcaagcattagaatttttaaaatcccatacaattttggaacatatattaatattatcactaaaatataacctgaataaggttaaacataattttgtcaatcccacttacatgaacctgtcaaaaaattctgtttacttctcttctggatgcttcagggccctctgtagcatacaaaaggtagggttcaggagagacaattttgaatgtgaagtttgattttgggaagcctgtcaaatgttacaggtttaaaacacttgatagtgtgaaatacaattccaggtaacacataagttatttattttggcaaaaggatgactcagaaattttaaaactaggcaacatcctttactccttaagagggaggacttcgctttccaaacagtttgtctcctgtctactcttttctctctttggcagtctcccaacaaggcaaacaaaatatttcattattcttctctattacatgaaaaatctgtacaagggaaagaaagccaaattttacccttacattggtttcaaaataatcctttttcattggcaaggtttatattttatgcctttttataatcttttatgacaaacacattttactgttcttacacaccttgcaggtaaatttatttttagttgtcttatttacatgttttaatggtaaatcttaccaattttaacgttaatataaaacctggtaagttgttttaattatgtactagatgcagataaagtctgatttttccatcatatttaggggcatggttaatttcatatgtccccaggccttaccaagttgtaaggtaggtagcatacaaccttgaaacatttagcaaacctggtatctaacttacatgatttaaactttctatttacattttgatgacatttgcattgtaccaatttcatctttaaaacaattactatttcttagaggttaaagtcccataaactaaaaggcattagagttttaactttcctctaaaatatttgatttaagtgcttatttttatttaaggcaatcaattagagctcattagagacatcacacacaacacatatatcactacacaggcaaacagaagaagatccagtagttctaagatttttttcttgtcccatttcctaattgaattattagctttccagtggagccctttaagagcaaggatagaaaaccatgaagtttctagggcctaatcaacttgtatagctgtaagacaaaagcagattttgagtggaatctatctatgagcctctaaattctggtattccatgaggaaaacagaggtttctcccaaaatggaacccatcatgccttttctgtttttcccaagaagtatcaggccagcaaaagttatcttgggttcattaagagtggaaagacagagtggagaaaacttattcagtcaaaacaaaagttatcttgggttcattaagagtggaaagacagagtggagaaaacttattcagtcaacacaaaagttcttttcaagaaaaacacaatccaagaagagaaaaacataaaggccttttaaatatacctataacatgaatatccacttttaatcaagctgagcattctttaagaaaatcatttgaaatatgctgttacctgactttagctaaatcaagcaggtaatatttctggcttttgactttaccaaaagtaatatcaaaggtgaaacaacaactctcaattaggttataagttaaccacgagtatacaagatatcttataagtggtggtaagcagcttttaccagatctagaacctttaaagtcaattcagagaaaagaagatttcagaaaggaagttagagttgttcatggaggaggaagagaagattaaaagtcacacagctattaacttgtaagtattcattacccaaaccaggagcgaacccgggccaccattataaaaaggcaatggctaaaaagaagtactgccacattgttacaggttatggtcaaggacataaaacaagatggagacttgcagcaaagtttgttactaaccagtttacaggggtgacttgaacagtgagcttacggagtcccaggcctggattccgttccaaggtaccctctctctgattgtttcttgtattttctctcctttttctgagactcctcctagtacctgttatgaaagactggggtggctactcttagaaggttttttaaggtgccatctggttctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagggttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatttcttccaggcagaagctagaaagagaggtttgaggtttaacagactgtcactatatatgcctcccagctgtagaaaattaacttgtctcattaataaactgttcaaattcatttagcagtggtgagcttttacatgaaggaaaagcaactaaaatggagagggatgagggtattcactcgggatgaaatatcttttcatagagtaccatgaatgactgttattgtgggacaaaaagcacttactgggtgaaggtttagactgaaatcttgaaatcccctggtattttgagtttctgcttagcctttccaaaggaataaaatcagatatgtatctatctcagtgagcagaggagtgactttgagtagaatgggaggaaggtttgtcctaggcagtttcccgcttgaattttccctagtgatttcaggggcccagtatattgtcctttcacacatctgacaagtaattgataaccagaatatctaagcagctcaaacaattctagaggaaacatatctaatagttggatcaaaaagtgggcaaaagatttaaatagacatttctcaaaagcagacagacatatggcaaacaagcaaatgaaaatgtgctcaacatcatcgatcagagaaatacaaataataactacaatgagatattatctcaccccagttaaaatggcttttatataaagacaggcaataaggattgctggtgaggatgtggagtaaagtgaaccatcatacactttttatggttatgtaaattagtacagctgctatggaaaacagtttggaggttcatcaaaaaactaaaaatagagctatgatgtgatccagcaatctcacagctaggtatatacccaaaagtaagaaaatcagtatattgaaatgatatctgcactcccatgtttattccagccctgttcacaatagctaagacttggaaacaacctaaatatccatcaacagatgaatggataaagaaaatgtggtacatacatacaatggagtactattcagctataaaaaaaaatgagatcctgtcatttgcaacaacatagatggaactgtacattattatgtgaagtaaaataagccaggcccagaaagacaaacatcacatgttctcatttatttgtgggagctagaaatacaaacagtggaactcatggtcataaagagtagaaagatggttactagaggctgagaagggtggatgggaagcaagtgggaatgttcaatgggtatagaaaacagaagaatgaaaaagacctagtatttgacagcacaacagggtgactatagtcaataacaacttaattgtgcattttaaaataaataaaagaatataattggattgtaacataaaggataaatgcttgtggtgatggataacccatttaccctaatgttattattacacattgtctgcctgtatcaaaatatgacacatgccctgtaagtttatacacctgcaatgtaccaacaacaattaaaaatttaaaaaggtgtatccttcccagtgaaccaaaatattttacattgataacttttaagttatcatagtgtgttggaataatcacagctttggaaagaaaaaaattatagatataaactttcaaagatggcaggagatatagatctctctttagtggattaaaatatgccatttgttattaacatcacactgagattttttaacacaggacatcttctggaaatgatatgattataggagttataggaaaaagcgttttttcatactgtgattacctatgctatgaagaaaggagatatttcctctatgatgtctaatttagcataattattgtttttaaactatatttagatttaattaagagatacacaaacaaattacttttagtagtaagaagatttttaaaaattttttgtgtaagatgactatgtagtaaagaaggttacaaacttactttttaacgtagaaaaataatctcaccttcttgccccatggaaaattgaaatgttatgtggaacccagtgtagaaaaactctcagtgaggttttctgtcttaagtttcagtggattgaggtgagatcaacgcctgttccacctttttcctccctgtcctagcaggcttgaaaacatttatacagccataaaatgttgcctttaaattcaagtatagaaaataaaatttaaaatgtgatatttttatatattttattttaatatcttacatgggaaatgtttttgaaatgttaaaaaattaaaatttttaaaagagtactgtgaaataatctaatcacatgtggaaattttgttactatttccccaagcatttttggtacatttaatgagttgaatgtaactcataagtagataaaaatgtttaatatttaattttctgctgcaataatgttacaaaacaaccttaaattctcagtaacgttaaacaacatatttttttctcccaaatttccaggttatttaagggcagttctgcttcatattgcagtttgcctgggctttactccaggctgtgtgttggagttaggtctaatatattgtatccctacgtatcccagttagaaagcctaacagatttctttgtacttcagtcagctcgattgtatttgtcattcaaaagccaaagcatttatcctaacaccaattgcttcttttttttttttagatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtaagccactgcacccagcctaactgactgcttcttttgttctgtagtctttctccaaaactgtttttctctgtactcactttcaccttctctcacacatatatgtccctcatgtccctttatgtctccagggtcttctatttccacgtaatcttaattgttcatcatatcctggactcatgagtaattaatctgttattctccctgaaagtgcagccttgttgaatagaatgtgttctttaaagagcagctttgtttctcgagtgaggtattaacttccagatttaagtgaaaatgagttccaagttttatgtttcattgtgtgtctaagactgacaccgtttattactgtggcacttacagcttgctttcaatgcctccaaattctctatctgaagggctgggtaccatatctcatgtctgaacatattcctcagaatcatgcagtaccagctatgttccttctttatattatggctcctgaggtgcctgttaagcagccaggtgaaattgccttttaatcagtataggaacagtctctttcctgctgatgctaatgctttttgtaaaaaggtcatgctgtattgaagttcttctttcacggcaaaaccactaatggaactcatctacttactgatgggtggaagctctttgtatgccaaagtcttgttttgtttgtgaagaatctctttccctcaacagtgatgtgctacgttaggtctcaaatcattgttgctttttaatccaaatttatgacaaagattttcagtttgtatgcataatttccttctctggccttaaccatcagtctgtggacttgccaagcaacaaccacaagaacaacaagtctgaggtcaagagacactatttagatctcagaatcatttgttgtcctttatcctttgacaaagttttgcctttctttctttatgagattttttccctaatggtttctcaatctcttgagaagaagaaagttcttgactcttgcagtctttctcattagttgaattataccatcagtacagcttctgatcatgtcgagaaatccaccatgaagaaataaaacatttccgattacatggattacgtttcttggattcttataggcattaaacttcattctaggatacaacctcatgatcttgtcttattctcagaacaagaaatatattactatatacattacaatatatatatattgcagtttccttgctatatatatatatatatgtatgtattatagtaaaccctgtaggcaagcaggaacacttcagaagtctcaatgaatccatcattagctgttagtaatgacaacactgttagaattatttcaataatcacacattgttatggtctgaatgtgcacccccaaatgtaatatgttgaaattttaacacctgagggcatagtattaggaacttgggagtggaactctttttagtgctattatgaataagatgcttgccttttccagcaaatgaggacacagccacaagctgccctctaggaactatgaagttagtcttcaccagacacaaaatctgcttgattttgaatttagcctcccgaactgtggaaaataaatttctgcttttataagccactcaatttatggtatttggttattgtatcccaaacagactaaaacacacattatttacctcctttttggactgtctggggttgttgctttaaacttgcttcagtgcctagaactgctccaagctccctgtcctctggcacacacgtataaataattctgctggaaaccgacatgtttcactcagtcatccaaatgtatttataatgttgtccaaatatatagcacttgttacaatgtttacattttagacatattttgagatatgtgccttaacagagtgctgtgattattattaatatttagtaacttatcttaccagacctaaactcaaagtttttcacaatggcaatgccttatttgggacttatttgggactgaatgtatgaagatcttacattgagtccaaattgatttctctgttagtctcgcaataacattaaagccacagaattatctgctgtatatttcttgtcttgttgtagctgatattctacatattaggacaattaggacattagtaatatctattaaccttagaataaaatgtcatattgaaattgaagaggaatattggaactttgctaagaaagaatgcttttcacacacaatgatatctaaaatggagcctctgttcctggaggtatattttacaaaaattcagtgttactataggaattctgtacacttctttcttagacatttgtattccatcagtgtcagtcctctctgtattttaaactaaataggatttctttttccatctttctgtttgacaagtattgttttgctgaaaatttgctattcatgttcttttaactcattagaaagaatatttagggtctttagtgacaaatgacatggtataaatgaaaagaaaacactgacattgtaattgagaaatactaattaattaggagaatattatttaaaaacattgtttaaatatttctttgttttattattattatactttaagttttaggttacatgtgcacaatgtgcaggttagtacatatgtatacatgtgccatgctggtgtgctgcacccattaactcatcatttagcattaggtatatctcctaatgctaaaccctcccccctcccccaaccccacaacagtccccagagtgtgatgttccccttcctgtgtccatgtgttctcattgttcaattcccatctatgagtgagaatatgtggtgtttggttttttgtccttgtgatagtttactgagaatgatgatttccagtttcatccatgtccctacaaaggacatgaactcatccttttatatggctgcatagtattccatggtgtatatgtgccacattttcttaatccagtctaccattgatggacatttgggttggttccaagtctttgctattgtgaatagtgccgcaataaacatacgtgtgcatgtgtctttatagcagcatgatttatagtcctttgagtacatagccagtaatgggatggctgggtcaaatggtatttctagttctagatccctgatgaattgccacactgacttccacaatggttgaactagtttacagtcccaccaacagtgtaaaagtgttcctatttctccacatcctctccagcctacaatgaactcaaacaaatttacaagaaataaacaaacaaccccatcaaaaagtgggcaaaggatatgaacagacacttctcaaaagaagacatttatgcagccaaaagacacatgaaaaaatgctcatcatcactggccatcagagaaatgcaaaacattgtttaaatatttctatcacaaattgacagcagtacaatgcacaccaccagcaatgtataattctagatatgagaggtaaaaagataaaacaggtattgcattttctccagaaaacttatcatttagtggaaactggccaataatttcttaggccttaggataattttacctttgattctctagttaatccaaaatatataaaaatattaaccaaaagtatatatttttaaaatgcctacataatctaatgcagtattttttgctctcttcttgaagtgaattaaattccttatcactgaccataaaattgaactccattgatgattcttatttaaaatagttaaaagtgaatgtaaagatcagttgtggttttccttttcttacccttgtttttacacttatatttgcctgtgtcattcacacacttttagaattcaaaacaataactagaaatgtaatcatttgcttttcaaaagcttttcgcatctttccaaagttaatataaagtcttacaaaacttttagctaattcacaaaaaaatcaaacatatatagttgaagcaattttttttttttggtagatttcttcaaaccacagaaatttcagttatggcatggtaggtcttttgaaatgtttcattttttgtatttgaagatgcagagcaaaagtatttccactccaactcccctttaataaaaattgaatgtaacaaaaaaatcaaaatctataggaaaataaccccttcatctatgttaaaactatgagatttccagcccaaataagttataagaaccagtatagagtccaggctcggtggctcacgtctgtaatcccggcactttcggaggctgaggccggaggatcatgagttcaggagatccagaccatcctggctaacatggtgaaaccctgtctctactaaaaatacaaaacaaattagccaggcatggtggtgggtgcctgtagtcccagctactcaggaggctgaggcaggagaatggcccatacctgggaggcggagtttgcagtgagtggagattgcaccactgcactccagcctgggagatagagtgacactccatctcacaaaaaaaaaaaaaaaaaaaaaaaaaaaaaaggaccagtatagaaatactaatacagtaaaaggtggacttatatataaagaaaataaccaacagattttgtctatggcacaaacttcttagaaattttgaggtctttagccttaaagacctaatcaaatatttattactttgaacagtgagctactgggatatgctgggctttgagcctatgtacaaatctaattttagaagtcaggacgtgttgtaagcaatagcaaagaatatgctagatgatcagcttggcaattgttgaacaaacttcattcagcagtgtgaggacgtaattaaagcagttgaccttcaatctattcactctctttattggcaaatggccgaggaataagactagaaggaagatgaactggtttagtctctttgtcagctgaacttgtggtgaaagagactactgatattttctaggatgaagagatcttatctctgaaataccctttgcaggttgctcctgactgaaacaaattcacagattctttcttctcgctcaattttgctgttgattcttcattttacattctttatttcatttattttatgctttagctctagaattttagtttgggttctattttttcaatctgtctgtggaacttctcaattggtttgtgttttgttttttttcaagttttggttgaattgcctatttattctcttgtaactaattactctcctttaaaacaattatttgacatgaaaaaccttgcaaaaatacaaaaatctataaacttcttgacaaagaattcaaaataattattttaaagaatttctgaatttgcagcaaaagtttgctatagagcaacatgaaagcacagaaaagtatgaaactcattgattaaggtaaatatataaaaaatacagaacactctaatagtgtagtagtggtgtgtaaatcagttttattgctagtatgaagcttaaaatccaaaataataataattatagctacaataatttgttaatagatatagaatattaaaaatatataatgtgacaccaaatatataaaatatagtgggctgagtaaaagtatagagttttgaatatgatcaaacctcagtttaaaatagtttgctccaactacaagatagtatgtataagcttcatgctattcggaaagcaaaaacctatagtagatacccaaaagacaaagagaaatcaaagcatgtcactacagaaaatcataaaatctcaaagaacgacagcaagggagaaataaaggaacaaaaatatgttaaaaggctgaaaagcaatgaacaaaatgtcaattgtatgttcttatctatcaataattaccttgaagataaattcattctattctacattcaaaagccagagtggctgaatggattacaaaaggagacccaacaatatactgcctacaagagactcacttcagcttcaaggacacatatggtgtgaatttaggggatgagaaaatttgatattccatgcaaattaaaacaaaaaaacaacatggataactatccttatatcaggcaaaatataccttaagataaaactctaacaggtgataaagatggtcactatataatgataaagggatgagttgattaaagggatgaaacaattataaataaatatgcacttaacattagagcacttgaaaatgtaaagcaaacattaatatctggagggagagatacagagcaatcaataatactacagatataggtaaccttattgacactgttgaaattatcaatactccaattacaacaatggatagatcatttagacagacaatctgtaaggaaaaaaaaattagacttgatctgcactttagaccaaacggacctaacagatgtatgttcacatttcatccacagccggagaacaggtgttcttttcaagctaacaagaaacatcctctaaaatagagcatacttgaagtcacaaaatgtcttaatacatttaagaagattgaaattttatcaagtatctcttttgaccacaatggtatacaactagaaatcaattaacaggaggaaaactggaaaattcaaaaagaagtgaacataacacaattcttaaaaactggtggtttaaaaaggaaataaaaaggaaaataaagaaatcttgatacaaaaatgaaaacacaatacaccaaagcttgtgggatgcagtaagacagtgctaagatgaaaatttgaaatgacaaacacctacattaaaaaaaacacaaatatttcaaataaacaatctatcattaaacctcaaggaactagaaaaaaagaagagcaaactaagcccaaagttaatagaagaaagaaaataagaaagatcaaagcaaaatagagaaatagagagtagaaaagtaatagaaattgaaagacattctgtgttcatcaatgtgagaaattaatattgtcaaaatgctattacacaaagcaatctacagattcaatgtaatccctatcaaaagtccaatggcatttttccagaaacagaaataaatcctaaaatttgtatgaaattacaaaagactataattacccaaactgatcttgagcaagacgaacaaagtaggaggtaccacacttctcactttcaagttatattactaaactacagtaatatatatatatatatatgatactggtatgaaaacagtcacatagaagaatggagcagaatagaaagcctacaccaatatcgtcaaagaatcttcaataacatgcccaaaacacctaatggagacaggatagtctcttcaataaatagcgttggaattattggaggcccacatgcaaaagaatgaaattggagtgttatgctatgcacaggaataaattgaaaattgaaaaggaatttaaacataacatctgaaaccaaagaatccctagaagaaaacaggggaaatcctccataacattgaccttggcatgatattttggctatgaatcccaatgtatagacaagataaacaaaaataaacacatacaactacatcaaactaaaagattgtggcacagtaaataaataaataaataaataaataaataaaaagtcacccatggaatggtagaatgtacttgaaaacaatatatctgataatgcattaatatctaaaacatataagaaactcataatcagaaaaaaagtaacctgattaaaacatgagcaagagacctgaatagacattttttcaaaggaagatttacacacggccaacacatgaatgaagaggtgcacaaaatcactaaacatgagggaaatataaactggaatcaaaatgagatgtcacattacatctttcaaaatagctaatatcaaaaaggcaaaagataaatagtgttgacaagaatgtgtcgaaaagagaacccttatagagttttggtgggaatgtaaattggtacaaccattatggaatacagcatggacactcctcaaataattaaagatgtaccgtatgttacagaaattatacttttaggcataaaagtatatacctgtgggtgtgttggctcacacctgtaatcccagcactttgagaggtgagggaggcagattacctgaggtcaggagttcacgaccagagtcgccaacatggcaaaaccgcatctctactaaaaaacacagaaattagcccagcgtggtggttggcacctgtaatcccagctacttgggaggctgtggcagggagaattgcttgaacttgggagacagaggttgccatgagtcaagattgcatcactgcactccagcatgggcatcagagtgagactccatctcaaaaaaagggtatataccttttatatacttttccttttatatacgatagaaataaaatcactatcttgaagagatatctgcattcctgtgttcattgcagctttattcacaaaaaccaaaatatggaaacaatctaagtgttgacagatgagtaggtatgtaaattatgatatctatcatctatctgtctatttatctatctatctatctacaacggaatattattccgtatttaaaagaatgaaattctgccatttccaacaaaatgaacgagcctagaggatattatgccaagtgaaataagccaggcagagaatgaaaaatactacaggtacaacaatgaaaacttgccattataagatgaataagttatggaggtctaatgcacaacagggtaaaaatagttagtaataatgtatgctttaagttcactgagtgtagatcttaactattaccctttcccaacacatgataactatgtgaagacatgaatatgttaattagcttgattgtgaaagtccttttaaaatatacttgatgggcgcagggtgagaggagagtgagggtcaaaacactacctgctggggactatgctcactagctgggtgatgaaatcatttgtacaccaaaccccagcaacatgcaattacccacgtaacaaacctgcccatgtacctcctgaacctaaaatagaagttgagaaaagaaaaaaaaagatatcaatttcctataaggagctccaggtttgttccaaacagtagcgagacaaacagatcaaggatgaaatatataaaatagtaggcaaaacgtaaacaacatgtgtaaggcaatcgattctatataactcagcaactcctagggttcttatcaaataaaatcactgatgtgtcataacttctaaactaaaaacaacacaaatgcccattcacagtagaatgaataaataaattacttttgcttcccgcgatgaataccacacagcaattaaacaatgaactgctgctacacaaaacatagatgattctcacaaatttcaactgagtgaaacaagtcagactcaaaagattacatacagcaagtttccatttatatgaaattgaggagtagggaaatccatcgtgatagatttcatgataatgatgaccattggtgagtaactggttgagaaagtgcgagagccaggggtgtgggagctggaaatcgtccatatcttgcttgatttgggtggtggtgatagggatatatacacttataaaaattataatgctatatgcttaagatttatgtattttactatttgtaagatatatattagttgaaaaaatgcttcagtgtaaaggaaaccagtaaaaatacgctacctacaattgtagcttttgtttatcaaaaaagcatttgagtagtctattgattggtaattagcaagtttatgttaagcagccttgtcctgaatactttttagtatgtaccattaagcatttgcctttctcaactagggctaattaaaaaaaactcaaaacctcacattgtacacgttgaatatatataattttaatttgtgaattataccaccataaaactaaaaatctaattaagttgagtttgaatacattttagggaaaatacgataaagaaaattaggagcttaagaatatgcatagataaaaaataaacttgatagaaatattatttatatattatatattatgtatatttatatatatttatatataatatataaataataatatatatataaataatactatatgtatttcagaaaatcatataaaaagctgtgctaaaattttccagagagagagtaaatagttctcctgtagtggattaaaatgagattagcattggagtactagcgtaatacaacagatagagtctgaagtcagatctcaaaaatacaatatatttgctaagtaatgcgagacaagctatttaaagtttttggacctaaatatccagtctgtaagtttgttggaaaaaataaatacgctaatagagaacttaacttacagggagtgctaaattattacctgttactggaaaacataatatcagtgacattaaaagcttgagtgttgtagaacaatattttgaaatatcattttttgaagttatatacatatttatattactttaataatttgcacaacataggaaggaaagcttgctttgcacaggcaacatttttgccaaataatctttaaatcatcatgaattctcaattagattaacaataataaaattttattgtagaagactattttttcattaatatagttgtacatgcacatagggtaaatgtaatattttgttacttgcctaagctttataatgatcaaatcaaagtaaccagggtgtccataatctcaagtattatttccatatgttaagaacatttcaagtcctttagctattttggaatatacaatacattgctgtttatatgtagtcaccttactctgctatgaaatattagaacatatgtcttccaagtaattgtatgtttggacctattaacaaacttttctttattcctcccacccagagaaactttccagcctctggtatctatctataattctattctctacctccatgagatcaatatttttagttttcatgtaagaataaggatatgtgatacttgtttttctgtgcctggcttatttcacccaacacaatgacttccagttccatccatcttgctgtaaatgataaaatctcattcttttttatggacaaaaagtattctactgtgtatatatataccatgttgtttttattcattcatccattgatggacagaggttgatttcatatctttgctattgtgaatattgcaataaatatgagagtgtggttatctctttgatatactcatttatttacctttggacaaatagctagtaataaatagcttgcacctctggtctcagctacttgggagactaaagcaaggggatcacttgagcccccgaggttgaggttgcagtgagccatgatcactccactgcattctagcttggttgacagagtgagaacctctccctcctaaaaaaatccttaagaaatgtgttgatgcctggttcccttggtcagaattttcatttgatgtgttgagagtgtagcacagatgttggaatgaacctctcaagctgattttaatgtgcaaccaagtttgagaaccaccaaggaagagtttttatgaattaagattcctatactctatcctagaactaatacaactgaatctctgggaatggagtatcagaatcagatttgaaaaggtttccttagtaattctaaggactgagcagtttggatactcgtttgttagagtaaaatggttaggtacctagtatcaacataggcacccaacctgatattaataactaggaaaataaagggttggcgcctctgtgtttctttgttgaaaaatctgatactattcttagttctatgaaaacaattgaaaatttggttattatcaccttaaaagtacaaaacctatagatattgaaaatgtaattatttttctataggcatagttgaaatgattttgtaaatgttataaatcagtttctttataagcagttcatttacataaattttgttaaactgacatgattcactaattttctaaatataaatggttcagctctcagttatttttaaactaatgacctgtgttatacttactatttttaatgggcttttatgatgtttttaggtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatggaatagtgtttgcattttttgtttacctggtttaagatgtgcagcagaacataactagatgattacataatttctttttaaggcaattttataatatattttatttatgattataaaaactgcctttaaaaattcttacatggatatcaatgcagtttcactttttttattgtaatcttttttataattattttatacttgtctggcattgagttttattgggcttttggttttttggaagtagggtatttatcccaatttagaaaatttgtatccttgccataatacagtcttccatttttgtacccccaaatctttcatctgtcagaacatcactcaaaggtgaaaatatttcccacataaaattattctgttcctttaatgaaatgagtttcagctgtatataagtaggaaaacttccttttgttctatttgattcctttttacggatactttcttgaggctgtgattacacctttaccttagaggcactgcccaaaaagactcagctcttctgtaaaaatgctgttatgaatcatagcttcttaacttttacaacatagtgaggtagggaaagtaagaacactagagataggaattagaagcatggagaagtgaaccctggagcttcccaatggtgagataccaaatagttcaagaactagtaaagaagactacggaggaatagctagaagctaaatgaagaaagtatctcaaacaggaaggagtgatctgttaatgtgttaggaaagttgagttcttaggattaagcattgggtagagcaagatttgggaccttgactttgacgaacttggtggatgtcaggagtaagaggaggtattcaagagaatgttggagaggaatttaatatagtgagtattgaggacaacacttaaggagtcttgctttcaaggggatgtgagaaatgggttgttaatggagggtaatgtagtatcaaaaagctgtttattttgagatcgatgatatagtaggtttgtatgctaatgggactgattcagtagacagaaaaagcataatgcaggaaacagagggatattgctgaagccatagacctgggacacaaatagaagggttagttttaaagataggcccacaaacagctcattagtaacagcaggatgaagggcagattatggagttccagatgtttgtagtccagtagataggaggagcatgtcaaatttttgtgatattttctcagtgaaacaggaagcaagctcataaagagggaggaagtcacgaaggagtaaggaaggaaaaggagatgtaaaatgaatagataggagtgtaggaaagtaagcatactcttaggaaatctgtggtttatttaagtggtatcagtcaatgtggttctgtgtttttctccagttgagttcagcataggtgctatcactgaaaaagtacagaattcagtttaactaaaggtgagatttctctaggtgaataaaacagtcagtgatgagatgttgatacatttaagagaatgattataaaagagggatgtggaaagtagtctgggttaagtagtgaagtgagaaaataaagaaggttgagacagtggaaaatggaatgatcaattgtagattgcagtgtggttgaagatgcaatggacttcttgaggtgggaactagaaatttgggggatataaataagagaggggtgactgaaattgaaaatatgagagtataatagtatacaatattactaagtatggtatactaagtatagtagaatagtactaagtatagtagaatagtactaagtatatagtacttagtgagtataagttttaggatgtgaagaggggagtagcgtagaggcaaggtgatggaagcagatgagttcaagaaaatgagaacctaggagattgaaaccattatctaaatgaattctgaaatctcaagaagaactgtgctgagtgcttgtagtcattattttgtctttactactctgtgagaagacagcacttccttttgtgagtaatggaaagttctttaatatgtcaactgtaagatactttattacatttaattatctttagtaatgcatagtaataactaatgacctcagtaggattattcagtagatatgtgagctaaccccctgtgtcagacacctaagaggaacaactgatgtttttcaagacgaatagagggttctcatcccagggttttaagctgcaaaatatcccaccctatattttctgaaaacaaacgttatatagagtgtccacataaaagctaacaggaaatattacacacacacacacacacacacacacacacacacacagcattgaaaatgcatcaggaaagatataccctgtacccaacatgcacaaggtctaagcaatgaagaaaatctaggaaatcaaataagaccagaacatctatgactaatatataaatacttgaggcagttatatccatttaaaaggtgtcaattagacatgaaagaaaaaggccaggtgcagtggctcatgcttgtaatcccagcactttgggaggccaacgcaggcggatcaacgtgaggtcaggggtttgagaccagcttggccaacaaggtgagaccccgtctctactaaaaatacaaaaaaaattgctggttatggttgcacgtgcctgtggtcccatctacttaggaggctgaggtaggagaatcatctgaacccagaggtagagattgcagtgagctgagattgcgccattgcactccagcttgggtgatggagtaagattaaaatatatatatatacatttttacataagaaattttattttaatttttttgtaaattagaaaatagcaattaatatggtatttatataccagaatctttgaatatctaaaatttaagaagatgtgagcaatttcatgaaacttttcaaagcttagaaaaaggtagctatgtaaaataacaatgtatgttgtttatgggaacattagatgaagtaagtcatgaaaacatgcatagaaatgatcatataaacttgcaagaaattgaatgtcttgctatcaaaggaaaggatggaggtgtaagagactgaggtagaatgtgagaagctctgtatatattgtattttccttaaaaatatatatttaaactcgcatttcttgtttttcaaatgttcactctaatgaaaattcttttatttttcctgttacagtttttatttctgatctcatatatgcagtgtactgttgttcagaaatatcattgatcctccctgcaaatgaaatactctcatcctgttgaatttgagaatgtacacatgatttgctttggctttgaaatgtgagcagaaagaatgttttactttggggagttcccaattgctaaaccatgtgtcaaaatgaagtttttgtgacattacaaatggactaataagagtgcctttgttgatcctagttgaacatgagaaacttggttattgtaagccactgaaaaattttagtttcttttattactgcagaatagcctattctgtcctgattgatacagccacaacatttccttaagctctttgattttcatattgccattaggatgtagaatgccaagagaaggataaatcataggatcagagaatgttagcagtgaacgagactattggaatacattttttcaatggtttccagactttgggttctaagtaatcagtaatatttcgaaaaagtagtaaaagatatttcaatataaaaaataatgacatttaactttgaaaaaaaaaacctatcattgctaggcataatgggtctagcttgtaatcccaacaacttgggaggctgaggagggaggatcacttaaagtccaggagtttgaggctgcagtgaaccatgattgcatctccacactccagcctgggtgacatagggccacctcaacaacaaccaccaccaaagctatcattaatacattgttcctctgtctctcttcccatcctccttaccacttagtcttaaatctaatcttattaaacaatatctaaggaaaagataagaaaaatgatggttgcatctatactgaacatgtgttgacttttttcttgtcactattttctaaacaacacagtatcacaacttttgacatagcatttatgttgcattagttattataagtaatctgagatgatgtaaaggttatatgcaaatattatattttatataaaggacttgagtaattattactttaagtatccatggtggttcctggaacaaattcctcatggatatggagggaggaggaatcactgtaattaaacaaatcatcactttaaaacttaaaaccttttgcatgttgaatacagtcatgcaccacataaatgatggtggtcccattaagtttattatgccatatttttatcggaagtttcctatgtttaagtgtatttagatacacaagtacactgtgttacagttgcctatagtattcagtaaaataacatgctttacaggtttgtagtctaggagaaataggctaagccatctaggttaatgaagtccattctatgacatttgcacagtggcttaattacctaagggctttctcttcagaacctactcttgtcattaagcaatgcatgactgtagttggacaaaaaataataatgcaggcatacctttggcactgtcctaattcttaccagcatccatgattgcttaaatttgcactggaaagacttcaaaaaacagtgatatattaggacaatatatttccagtacatgacaaatgataacaacataagaactcgaaacactcaataaaaaacaaaaaataaagcaaaactagatgggaaaaggaagaagcaaatttcaagagaaaactcaaaaggccaaaaaatgtgaaatgatgttcagccttgctagtaattgggaaaaacacaaatcattttttttttttttttttttgagatggagtctccctctgtcacccacgctggagtgcattggcgtgatctgggctcactgccagctccacctaccaccttcaggccgccattcccctgcctcaggctccagagtagctgggactacaggggcccaccaccatgcctggctagttttttgtgtttttagtagagacagggtttcaccatgttagccaggatggtctccgtctcctgacctcgtgatctgcccgcctcagcttccgaaagtgctgggattacaggagtgagacacgtgcccgacccaaatcatttttaatctattagtcaaaaattagagctatgataatattaatttttggtgggagtgtggcaaaaggtactataatatactgctactagagagtaaaaattgataaattttgtaagggcaattttgcacaatatgaaaatataaaaatatgcttcatgtttaccatacatttatctagcatacagaattacccatgtgtaaacatgtatacagatgttcattataacacttcttataaaaacaaaatatttggaaataaatgttcatattaataaggcgcataccgtatgatcttagtccagttagaatattctgttttatttcaatcctttaaaagactcaacttctgactctatatagacgattaaaaaaagaatgtgttctccctttgtgcatttggtcaggtaaattaaaaaatacaccacatgctagccgcaccaaactggaataagcctttggaaagaagttgtccttgaagcttgtatctgacattgtagcaggacgagcctcagacaaaacctctcagacactgagttgtagaaggaagggctttattcagctgggagcatcggccagctactgtctcaaaatctgagctcccggagtgcacaatttctgtcctttttaagggctcacaacactaaagatttcacatgaaagggtcgtgattgatttgagcaagcaagggatacgtgacaaggactacattcactgctggtcagggagaaacagaacagggcagggagtttcacagagttcttttatacaatgtctggaatctgtgaataatatcagcttctaaatcataagttgatttttagctactgggtttaggccaatcaggcccaggcctggtttcaggcctggcgctgggctgcatgtctttggttgtacttcctggttgtttttactgaatagaaaacaatataaaacaaggagagggtctttgtctcctctcaatatcagcactggattgtagaatgtgttgctgattttgaccttgtattcaagttaactgttgcccttggtatctgtacatatctttgatttcagtctttactacacgtggcttggtcacttcatggctaaaaacatgcttgtggaagaccagtctggctcggtgagtctgtgcggccagcagtctctgatctgtacagggtattaatgtgtcagggctgagtgttctgggatttgtctagaggctggtaagggcttctggaccacttgtttctgtcctgtcagtctgtcagggttggaaagtccaagccataggacccagtttcctttcttagcttacgttatctaccagagcaccgtgggctgttacttaccttgagttggaaggggttcgcatttatacctgtaaaagtattcatccttttaatttatgtaaagtttttttgtatgccattctggatctttaaagagatgacaacaaattttggttttctactgttatgtgagaacattaggccccagcaacaggtcactgtttaaggaaaaataaaagtgctgccagaacctaagaaaaacattaatatctaaaaggtcatttagatgatttccatgagagactttttgatgttctttacctgttaggattattattgataatccttttcagattatgaataaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtgggtatgattcatagtatcaattgcggaattcactgtgcttgtaggaaatagtattctgatcttatctgtgaagcttgggcaacattttacttcacaggtaagtattctaagtaaaagagatttctgagggaaaatctatgtagtattcttggcaactttatattttgtttctgagataatctttcttcaccaagagccctccaatgtgctgttaatattttcaagagatagctgcctataccaagattcaagaatcttttatactattgattagtttctagaacattcaatgatacacagtaagacagaatttggtacttatgaagactgtttaatttgtaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggtaagtgaattctagtttcctttaaaaataacagacaggaaaatggtttctctctcttctttcttgctccttttcagcagaaaattttccgtattttatttttttaattttacttcataatttaaaactcaaaattaactgtttatttatgttcaacttttgtgaatatttgtgtgtgtgctatctactaaagaggtaagttaaagtttaaatcagaatttgcttctaaagcaaaacatcaaattttaacccttataactgttcgtatttcccggaaacaatttactggttaggaagtataattccagttacaatgtttgctatcatttttaggtgacttgtgtctccatccgtaattcttgggtttttcatggtgaatagctagcttctctatttaatgaggagcataaattgagattaatagctaccttgtttgtcttcaaaagcttcatagagagtacaggctttctcctggtgacccactgaaatttccaaaacaataacctttccactctcatctgagttttgtcttcccaaagtgggctttttgcatttcctcctatttatggtagtttctggtctctcaatttatcattcctataaatatttgaccaagtgtctagaaggcatgtaggtgtttagttcacattactttcctttcacagttgatttttgatcttgtaggaaaataattataagatatcatgaaatattttggagttttattaacatactataaacttgcatcaataatgctttaaatttctacctctctgtaagtcacactgaagtagaaactttgttttctaggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtaatttttttacgagagtgatctgaataaaagagtaatatatgccttttcttgtagacatgtagctaattgaatttcatttaaaataggaatttagatctcttagggacagaagttaacaagtttgactactttaagaaactcaaatccatatttaagaactttcaaatattgatttaagatttttaatcaatacacatttgcccacttctaagaagttcccaattaaaaatctcatcgactttatttcctaaattctctattttctattagaaaatatttcaaagatacatctgtagtagaatgtgagcatccccagtgcccaatgcaaggaagtcactatagaatatctcttgaggaatcatggaataaatgaataatccaatggattctcaggagaaaaatgaggttttatgaatcaatcataacatttttacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacttatatgcctataaaatatcatcttattcgttagaaaattaatggaagatttaattaaaaatgcaatttctgtaggataaggaatgagacatttacataaaacagtgttctttaacctcctcttcttcacatacagcatatctaattctttatcacaacatgttttatggaggtacacagaatgtaggatactgataatagttatgtctttactttctttggataatgaaacaagttaatatttatcaaggaatttcagtcgatactaaatgttttattagtgtgagctcttattattatcattgatgtagaagactaaaaattaggtaagtattttcacaggacaacaggtatctttgacattatgcttctttcaatattgtagcctatactttatcaaataaaagaatataagaatattacctgttgagataataggaataagaaaaccattttgcacatttcgtgtaacaaacaggaccaggcatggtggctcgtgcatgtaatctcagcactttgggaggctgcggcagggggattgcttgaggccaggagtttgggaccatcctggacgacatagcaagaccctgtctctaaaaaacaaaacaaaacaagacaaaaagaaataataaatagcttaatttattaataaataacaaatagcataaagctatttttatataatattaacttattggttaaaatgctttaaagtccttacacaaaatgttattgtttcctaaatttctactaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttccctgaagtatttcatggatctattagtcatactacctcagtgtgacttatcttctggaacattcttattcagacaactatcaaagagtcaattgtgaatgataagtattctagtgccctaaactctaatcaatcatcttttgtatttagagtgtctgtcacaaggcaatatgtctaggaacgctaaacataccctaggagttttcatctaagtacgagatgaatatactggatttgactgatgtttgcatataatcttttaaagccaggttattattaaaatgatcctatcatttatgaagtatgtacaaagtttccatcctgtagaatttacatgtattatatgaattaaaaatataaaaaatatttatattataacaatacagtattgaagccttattttaatctagtttgattaaactagattggtctagtttgattaaactagattaaacttcttggtctaggcacatgaatattgttgtggggaagagaattctgtataatgtgatatggatattgatccttctggagtgcctctaaatgataatgtgctgaaacctctgaaaggaccttttttaataacaaaaatcttatatttgtaatatgaatgtaagtattccatacatgtatatacaaatatggaccatacatgtagattacacatgtgtgtgtgtttgatgtgtgtgtatatatatgtgtgtgtgtgtttgtgtgtgtatatatatatatatctcttacaggaaaagcatttaattagagaaagaatttaatcttcagatgccatgccttacagagagagatgcacagttaagttactctcaaactgttgtgaaatgatacatcaacgtatatcttatttttcaaaaataggaactggggagaaggttggggtttcgtaccttctgacagagcgcttgtctttgtggataaccatgacaatcaacgaggacatggggctggaggagcctctattcttaccttctgggatgctaggtagaaaaccaagttctctatttttttaacacgtcttttaatgatggcaagaatattctgacatcctatgaaaatataattatgtaacttccaggctgtacaaaatggcagttggatttatgcttgctcatccttacggatttacacgagtaatgtcaagctaccgttggccaagacagtttcaaaatggaaacgtaagttttggagttgttcaatatatccttttctgaagaaaaaggaagcaatcttattctaacttaacatgacaactattaattatatatttattcaacaaatatttaattgattgtaaactggatacagggctgtgattttagtaatgtaggttatattaaaggagtaaaatttatattctccattgacaaagagtatgcaagctgtttcagagatatgacaaacatccccttagcccgcagggaaacaaaaaacaaaaaacagaaaaacactcaaaactaagagctagacacagggattaaaatatatacttcgaataagtacctacctcagggctgataggaagattatacatgccaacacttttagagaacttaaaacatcatctgcccgtagtgagaacaatataaatgtttgttaaatacttttaaaaagttatatggaatagaaagaaatgaatcaattgagctgagttaaatagggaaagtatcatataagaggaaggaaatgatatgtactaaagaatagaaatttagagagtattccaagaaaggtaagaatgagaaaaatatttgggagtatggtaaagacattaatctgatgagaagtttcaaaaaggaacagagaaattacagtgtaaagatatttggaaagctagtagaaggttttcttttaaactaaagggttcagaaacagcatcagagacttcagaactaaagcagaaattcctccttcctatgagtcacacggatatctagctagctttttttagattcctttcagtttgagaagtccgcactttgtatagcaatttattctattgttaaacagctttaatatttagaaggtgtacttttatattgagccaacttcttttaatttctactaattggtcttatttctgatgttaggagtcatagagtatttttattttttctattactataacatttccactttgccaggactgctgcatgctaaaaactcttagttttgttcacttttcaccatatgacatgattctaaggtcaacactgaaaaacttcctaagattcctctggattttttaatgaagattttttaaagtgccaatcagaaaaccataatatgaaaaatgtggtcaatttataaataatgttcagatgtattgttttgtacatttatctaaaaagaagcatgaatgattctaatatttattcagcacatgtcacattcaaggcattttcacatatattacttaatttttatagcaaaaaaaccaatattcccattttacaaatgaagaaactgagacacagagatattaagtgtattgattaaattttctcaggtactagtaatagagcctatgttttaatcctggtgtttctagtactaatgcccttcccatttcaatgacattgcatggcttaccacgatgttaagaagctcttgcaggccaggtgcagtggctcacacctgtaatcccagcacctagtgaggcgaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgatcatgccactgtactccagcctgggtgacagagcaaagaagcctttgcagttctttggaatgaaaaggagaggataaaaatttgttaccttgtttgaaatatgccagaagaaaaccagaggatagagagatgatgaagacccagtaaagggctataaacattaatgaaggcattggattctagataaagtcactgaatgcagagacacaagtaacaggattggttgggtttggtgtaaaggagaaggaagaggtaaatacatgcatagtaaaatttggctttttcccccctacttaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccactgcattttatttaaaacagttgaagtttaagaatatcaacgttttatatggtattgtgtttttaggaacatggttattttccgcaatgtagtggatggccagccttttacaaattggtatgataatgggagcaaccaagtggcttttgggagaggaaacagaggattcattgttttcaacaatgatgactggtaagtaaatatcaattaaaaataatattttgtaccagtatgttcttggtttattcttttttttctctgttcattgacttttatcatatctgaaaaatcatgtagtcagtggagcaagaagacaatagagatcaaaattgggcagaagcaaaaggatgatggctgttactccttcgttctttttttttcataagtgctttctgttgtaagcagaatcctttctgtgcacccttgcagtatcatatgcatatatatgatgcacatgcatatgctcacctacacatgccacaaaatcaatatataaaatcacaatcaatataaggattgtgaaatcattaaaaaaaagtgtcttataatcctgcttttttaaccatggagaaatgctgcctaggtactaaaatatctttatttctaactctttttctcaatgactgctctacgtagttttttggtacactttcttcacttctctgtctccttgtgacaaataacatttttaaagcacatgtatgaataatatgtatcttgtggttactgttttgcttcaggagatttgagttttatttttgaaacttctcattattggcctttcatctgtgattcttatatgctttacctgaagcataaatgattatctaagatatagctcagaagaccttggtgtaaacagttgaattgtccctgtccaagaccaactgacactcatacttagctcactctagtataaattatatttcactgatgaaaagtaaataaatacatcaatatacaagtcaagttgatctctttcctgccaaaaaagcccatgtctagttttttaatttctttcttttgtagatgaaaataccaaaataagtttttgtgaaaaagctttatatttcaaactatcacttcttcatagaaatgctagattatttttatgtgcatcccaaattcgttttgatctcatgggagaagaaggaggttaaaaaataataccctttaaatttttaagagtaattggtattaatttcagttgagaacaaatttgattttaccaaggtagaacttttatcaaagtgtgaccgttcctgccaatcttcagtgatattcttcaactttgatgttttggtaatattttcactactaaccaggaaattgctaggttttctgtaaggttacttttggtcctagaaagctatttccacctactagagaggcatatgggttttcttcttaataagacttcactgcttaggtttgtttctacaacataaagttatgctgtttatttgtgttagtctgtattcttgattttcattgtattgaagatcaaccttaaattttattttacaggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaatagccaagtgtgtttcttttcttacatgtacagcagtacttatatttcattaatttttactaaaagctctaattagtaattagaggttcaaaaaagttgatagtgtgaaacacaattccaggttacacagaagttatttattttggcaaaaggatgtctcagaaattttaaaactaggcaacaacctttactcattaagagggaagacttagctttccaaacagtctgtctcctgtctactcttttctctccttggcagtctaccaacaaggcaaaccaaatatttcattattcttctctattacatgaaaaatctgtacaagggaaagaaaaccaaattttacccttacattggtttcaaaacattcctttttccataggcaacgtttacatttttatgcctttttataatcttttatgacaaacacattttactgtttttacacacattttacacactttgcatgtaaatttatttttagttgtcttatttacatgttttaatggtaaatcttaactttgccattttagttaaaatggtaactttaatgtaaaacctggtaagttttttcaattatgtactagatgcagataaagtctgactttttccatcctagttaggggcatggttaatttcatatgtccccaggccttatcaagttgtaaagtaggcagtatacaaccttgaaacatttagcaaacctggtatctaacttatatgatttaaacctcctatttacgtgttgatgatatttgcattttccaatttgatctttaaaacaatttttatttcttagagatgaaagtcacataaactaaaaggcattgcagttttaactttcctctaaaatgtttgatttaagtgcatatttttatttcaggcaatcagttatagctcgttacagacatcacacacaacacatatatcattacacagacaaacagaagcagatccagtagttctaagatttcttcctgtcccacttcctaattgaattattggcttcccagtagagccctttaagagcagggatagaaaaaccatgaagtttctagggcctaatcaacttgtatagctgtaagacaaaagcagattttgagtgggatctatcagcctctaaattctgggattccatcaggaaaacagaggtttctcccaaaatggaatccactgtgccttttctgtttttcccaaaaagtttcaggccaccagacattaccttgggtgcatcaagagtggaaagacagagcggaggacagtaattcagccaacagaaaaattcttttcaagaaaaacacaatccaagaagagaaaaacatacgggccttttaaatatacctataacttgaatatccacttttaatcaagctgagcactctttcagaaattcctttgaaatcttctgttacctgactttagctaaatcaagcaggtaatatttctggcttttgaactttactaaaagtaacatcacaggtgaaaacaacaactctcaatcaggttataagttaactgtgagtattcaagatattttataagtggtggtaagcagcttttactagatctagaaactttaaaggcaatttagagaaaggaagatttcagaaaggaaattagagttgttcatggaggaggaagagatgattaaaggtcatacagctattaaattgaaagtattcatcacccaagctaggattgaacctgggccaccattgtaaaatggcaatggctaaaaaagtcctgccacaaggttacaggttatgctcaagacataaaacaagatagaggcatgcagcaaagtttgttacttaccagtttatgtgggtgacttgaatagtgagcttatggagtcccaggcctggattccattccaacgtattccaacccgttccaagatgggttgttacccatgcagaaaacggggggaatataaggtgtcccttagtctcctttctccttttgaagtgacccaggatgaagcaaaagattacaggggtgtccctgttctcctctttcctcccatctcctttgggtcccggtaaccatcataggtgctgtccatggatgaaagcatgaattgcacccatggatgtggaggtgctagctggcaggagtagtcatttttaccagcacaatgcctcctcacactgctcttctgggttcctaggcctcccaggagattctacagtagataaagttgggtgagacactttaatagagggagtgttttaaccctattcctgcctcctctagttatggacctggaaaagcagtgcattcccagaaaattttatccattgacatttaaatataaaatcccctttctgtttaaatgccaatgtggttggaagcagaacaggtgtctcaaaagaacatatagatttaatggctgtcctccttctgatggaaacagcactaaggctagaatttgtctctcaagggtggcttcctcccaactgttgaatgcggagtttttttccttagaaatggggcatagggtctgcttgctgttagaggaacacaaaagagggagaaatctgggcattagaattttttggcgaacggccaccaagaatttttacggagaaaaatagcctatctcatgaggtggtgctgtagggtctgaaaagttatgtaaaatctgtgactctaaattttttccaggaagaagttagaaagagaggtttggggtttaacaggctgtcactgtatatgcctcccagcagtagaaaattaacttgtctcattaataaactgttcaaattcattcagcagtgctgagcttttacatgaaggaaaagcaactgaaatggagagggatgagggtattcacttggggtgaaatatcttctcatagagtgccatgaatgactgctattgcgggacaagaagcacttactaggtgaaggtttagactgaaatcttgaaatcccctggtattttgtgtgtctgattacctttccaaaggaataaaatcagatatgtatccatctcagtgagcagaggggtgactttgagtagaatgggaggaaggtttgttctaagtagtttcccgcttgcattttccccagtgatttcaggggcccagtatattttcctttcacacatctgacaagggattaataaccagaatatctacggagctcaaacaactctagagggaaaaaaaatctaataattgcatcaaaaagtgagcaaaagatttgaatagacatttctcaaaagcagacagacatatggtaaacaagcatatgaaaatgtgctcaacatcattgatcagagaaatacaaataaaaactacaatgagatattatctcaccccagttaaaatggcttttatttaaaaaacagacaataacaaatgctggtgaggaggtggagaaaagggaaccatcatacactttttgtggttatgtaaattagtacagctgctatggaaaacaatttggaggttcatcaaaaaactaaaaatagagctatgatgtgatccaggaatcccacagctaggtatatacccaaaagtaagaaaatcagtatattgaaatgataactgcactcccatgtttattccagccctgttcacaatagctaagacttggaaactacctaaatgtccatcaacatatgaatggataaagaagatgtggtacatatatacaatagagtactattcagccatggaaaaatgagatcctgtcatttgcaacaacatagatggaactgaactgtacattattatgtgacgtaaaataaaccggcccagaaagacaaacatcacatgttctcacttatttgtgggagcagcaattccaaacaatggaactcacggtcatagagagtagaaagatggttactagaggctgagaagggtggatgggaagcaagtgtgaatgttcaatgagtacaaaaaacagaagaatgaataagacctaatatttgacagcacaacagggtgactatcgtcaataacaacttaattgtacaatttaaaataactaaaagaatataattagattgtttgtaacataaaggtaaatgctcgtggtgatggataacccatttaccctgatgctattactacacattatctgcctgtatcaaaatatgacatatgccctataagtatatacacctcctaggtaccaacaacaattaaaaatttaaaaaagtgtatccttcccagtgaaccgaaatattttacattgatcatttttacattatcatagtgtgttggaataatcatagctttggaaagaaaaaaaataaatgtaaactttcaaagatggcaggagatatagatctctctttctttagtggatttaaatatgcaatttgttatcaacattgcactgacaatttttaacacaggccatattctggaaatgatatgattataggagttataggaaaaagcattttttcatactgtgattatctaggctatgaggaaaagagatatttcctctatgatgtctaatttagcataattattctttttaaactatatttagatttaattaagagatacacaaacaaattacttttagtagtaagaagagtttttaaaatgttttgtgtaagatgactatgtagtaaagaaggttacaaacctgctttttaacttagaaaaataatctcaccttcttgccccatggaaaattgaaatgttatgtggaacccaatgtacaaaaactctcagtgaggatttctgtcttaagtttcaacggattgaggtgagatcagtgcctgttccacctttttcctccctgtcctaggtgacttgataacatttatacagccataaaattttgcttttaaattcaagtatagaaaataaactttaaaatgtgatatttttatatattttaccttaataatttatatgggaaatatttttgaaaggttaaaaaattaaaatttttaaaagagtatagtgaaataatctaatcacatgtggaaattgtgttactatttccccaagcattttttgtacatgtaattgaaaatgagttgaatgtaactcataagtagtataaaagtgtttaatatttaattttctgctgcagtaatgtgacataacaaccttaaattcttggtactttaaacaagatattttttttctcccaaatttctaggttatttaagggcagttctgcttcatattgcagtttgcctgggctttactccaggctgtgtgttggagttaggtctaatctattgtatccctacacatcccacttagaaaagctaacaaatttcctttggacttcagtcagttcgattgtatttgtcattcaaaagccaaatcatttatcctaacaccaacggcttatttatttatttatttgtttgtttatttatttatgttttagaaggagtttttctcttgttgcccaggctgaggtgcaatggcgcgatcctggctcaccgcaatgtccccttcccgggtcaagggattgtcctgactcagcgtcctgagtagctgggattacaggcatgcaccaccatgcccagttaattttgtatttttagtagagatggggtttcttcgtgtggatcattctgttctagaactcccgacctcagttgatccgccagcctcaggctcccaaagtgctgggattacaggcgtaagccaccgctcccagcctaaccgattgcttcttttgttctgtagtcttttgccaaaactgttattctctggactcactttcaccttctctcacacatacatgtccctcgtgtccctttgtgtctccagggtcttctatttccacgtaatcttaatttttcatcacatcctggactcatgagtaattaatctgttattctccctgaaagtgcagccttgttgaatagaatgtgttctttaaacagcagctttgtttctcgagtgaggtattaacttccagatttaggtgaaaatgagttccaagttttatgtttcattgtgtgtctaagactgacaccgtttattaccgtggcacttacagcttgctttcaatgcctccaaattctctatctgaaaggctgggtaccatatctcatgtctgaacatagtcctcagaatcatgcagtaccagctatgttccttctgtatattatggcttccgaggtgcctgttaagcagccaggtgaaattgccttttaatcaatataggaaccagtctctttcctggtgatgctaatgctttttataaaaaggccatgctgtattgaagttcttctttcaggacaaaaccactaatggaactcatctacctactgatgggtggaagctcttggtatgccaaagtcttgttttgtttgtgaagaatctctttccctcaacagtgatgtgctacgttaggtctcaaatcattgttgcgttttaatccaaatttatgacaaagattttcagtttgtatgcataatttccttctctggccttaaccatcagtctgtggacttgccaagcaacaacaacaacaagaacaacaagtctgaggtcaagagacactatttagatctcagaatcatttgttgtcatttatcctttgataaagttttgcctttctttctttatgagtatatttcctctcatggtttcccaatctcttgagaaaaagaaagttcttgcctcttgcagtctttctcattagttgaattataccagcagttcagcttctgatcctgtcgagaaatccaccatgaagaaataaaacatttctgattacatggattacgtttcctggattcttataggcattaaacttagttctaggatacaaccgcatgatcttctcttattctcagaacaagaaatatattactatatacattacagtttgtatatattgcagtttatatagagtatatgtatatgtactgtatatatatatgtacacatatatataacagtaaaccctgtaggcaagcaggaaaacttcagaattctcaatgaatccatcattagctgttagtaatgacaacactattagaagtatttcaataatcaaacattgttgtggtctgtatgtgcacccccaaaagtaatatcttgaaattctaacacctgagggcatagtatttggaacttgggagtggaattcttttttgtgctattatgaataagatgcttgcctcttccatcaaatgaggacacagccacaagttaccctctaggagctaggaagttagtcttcaccagacacaaaatctgcttgattttgaatttagtctcctgaactgtggaaaataaatttctgcttttataagccactcagtttatgctatttggttatagtggcccaaagagagtaaaaagacacattatttacctcctttgtggactctctggagttgttgctttaaacttgctttagtgcctaacactgctccaactccctgtcctttagcacacacggataaataattctgctgggaactgacatgtttcactcaggcatccaaatgtatttattatgttgtcaaaatatatagcacttgttacaatgtttccatgttagacatattttgagatatatgccttaacactgtgctgtgattattattaatatctagtaactaatcttaccatatctaaactcaaagttttcacgataacactgccttattagggactgaattttttaaagtatgaagatcttacatcaagtccaaattgattcatctgatagtctcgcagtaaaatcaacgccacagaattatctattctgtttcttgtcttgttgtagctgatattctgtgattggacatattgctaatatctattaaccttagcataaaatgtcatattgaaattgaagaggaatattggaacttggctaagaaagattgcttttcagacacagtgagaactaaaatggaccctctgttcctggaggtatattttacaaaaattgggtgctattataggaattctgtacaattctatcttatgcacttgtgttccatcagtgtcaatcctctctgtattttaaattgactatgatttctttttccatctttctgtttgtcaagtattcttttgctgaaaatttgttattcatgttccaacagaaaatagattttttttcttttaactcattggaaagaatatttagagtctttagtgacaaatgacatggtataaatgaaaagaaaatactgacattgtacttgagaaatactaattaattgggagaatattaattaaaagacattgtttaaatatttctatcacaaattgacagcagaacaatacacaccaccagcaaggtataatagtagatatgagaggtaaaatgattaattagatattgcattttctccagaaaacttattatttagtggaaactggccaataatttcttaggccttaggataattttacctttgattctctagttaatcaaaaatatataaaaatattaaccaaaagtatatatttttaaaatacctacataatctaatgcagtatgtttcgctctcttcttgaagtgaattaaattccttatcactgaccataaaatttaactacatagatgattcttgtttaaaatagttaaaagtgaacgtaaagatcagttttggttttccttttcttacccccgttttttacacttatatttgcctgtgtcattcatatacttttagaatccaaaacaataattaaaaacataatcatttggttttcaaaagctttttgcatctctagaaagttaatatagagtcttataaaacttttagctaattcaaaaacaaatcacacatatataattgaagcaaactttgtttggtagacttcttcgaaccacagaaatttcagttatggcatggtaggtcttttgaaatgtttcattttttatatttggagatgcacaacaaaagtctttccactccaactcccctttaataaaaacagaatgtaacaaaaatatcaaaatctgtaggaaaataacccattcgtctatgttaaagctatgagatttccagcccaaataaattataagaaccagtatagaggccgggcgcgatggctcacacttgtaatcccaacacttttgggggctgaggcaggcggatcaagagttcaggagatcaggaccatcccagctaacacggtgaaaccccatctctactaaatatacaaaaaaagtaattagccaggcacagtggcgggtgcctgtagtcccactactcaggaggctgaggcaggagaatggcctcatcctgggaggtggagtttgcagtgagccgagatcacaccactgcactccagcctgggagatagagtgacactctgtctccaaaaaaaaaaaaaaaaaaagcatgtagaaatactaatacagtgaaatctggactgatatataaagaaaataaccaacagattttgtctatggcacaaaattcttagaaattttgagatctttagccttatagacctaacaaaatatttattagtttgaacagtgaggtactgggatatgctgggctttgaggctatacgcaaatctaattttagaagtcaggaactgttgtaagcaatagcaaagaatatgtttgatgatcagcttggcaattgttgaacaagcttcattcagcactgtgaggatgtaattaaagcagttgccctgcaatctattcactctcttcactggcgaatggcccaggcataagactagaaggaagatgaactggtttagtctctttgtcagctgaaattttggtgaaagagactactgatatttttctaggatgaagggatcttatctctgaaataccctttgcaggttattcctggctgaaacaaatgcacagatcctttcttcttgatcaattttgctgtcgattctcattttacattctttatttcatttattttattctttagctccagaatttttgtttgggttccattttttccatctctctgttgaacttctcatttggtttgtgttttgtttttttcaagttttagttgaattgcctatttgtcctcttgtaactcattactttcctttaaaacaattatttgacaggaaaaactgcacaaaaatagaaaaatctataaatcacatgacgaagaattcaaaataattattttaaagaatttctgaatttgcagcaaaagtttgctatagagcaacatgaaagcacagaaaagtatgaaactcattgattaaggtaaatatataaaaaatgcagaacatgctaatagtataatagtggtgtgtaaatctcttttattgctagtatgaaggttaaaataccaaagtaataataattatagctacaataatttgttaatagatacagaatattaaaaatatataatgtgacatcaaatatataaaatatggtgggctgagtaaaagtatagggttttgaatatgatcaaagttatcagtttaaaagagtttgctccaattacaagatagtatatataagcatcatgctaatcaaaaagacaaaacctatggtagatacccaaaagataaagagaaatcaaaccatgtcagtacagaaaatcatgaaatctcaaagaaagacagcaagggagaaataaagaaactaataatatgttaaaaagccaaaaaacaatgaacaaagtggcaattgtatgttcttacctatcaataattaccttgaaggtaaattcattctattctacattcaaaacccagaatggctgaatggattacaaaagaagacccatcaatatgctgcctacaagagactcacttcagcttcaaggacacatatggagtgaatgtaggggatgagaaaatttgatattccatgcaaattaaaaccagaaaacagcatggatagctatccttatatcaggcaaaatatactttaagatacaactgtagcaagtgataaagatggtcattaaataatgaaaaagtggtgagttgattaaagggatgaaacaattataaataaatatgcacttaacattgaagcacctgaaaatataaagcaaacattaatatctggagggacagatacacagcaatcaataatattagggaaataggtaaccttattgatactgttgcaattatcaatactccaattgcaacaatggatagatcatttagatagacaatctataaggaaaaaaaacattagacttgatctgcactttagaccaaacggacctaacagatgtatgttcacatttcatctacagctggagaacaggtgttcttctcaagctaacaagaaacatcctccaaaatagagcatatttgaaattacaaaatgtcttaatacatttaagaagattgaagttgtatcaagtatcttttttaaccacaatggtatataactagaaatcagcaacaggaggaaaactggaaaattcaaaaataagtgaacataatgcaatccttaacaaaaagtgttttaaaaaggaaatgaaaaggaaaataaaaaatcttgatacaaaaatgaaaacacaatactccaaaacttgtggcatgcagtaagaccgtgctaagaagaaaatttgtatgacaaacacctacattaaagaaaaaacatctcaaataatctatcattaaacctcaaggaactagataaaaagaagagcaaactaagcccaaagctaatacaagaaagcaaagaaatatcaaagcaaaataaagaaatagacagtagaaaaataatagaaattgaaagactttctgtgttcatcaatgggagaaatcaatactgtcaaaatgctattggacaaaacaatctacagataaatgtaatccctatcaaatgtccagcggcatttttcacagaaacagaaataaatactaaaatttgtatgaaattacaaaagactataagtacctaaagtgatcttgtgcaagaagaacaaacaggaggtaccacacttctcactttcaagttatattacaaaactacagcaaattttatatatactgacatgaaaacagtgacatagaagaatggaacagaatagaaagcctagaaataaacctacaccaagacggtcaaaaaatcttcaataacatgcccaaaatacctaatggagacaggatagtctcttcaataaatagcgtttagaaaaactgcaggcccacatgcaaaataatgaaatttgacagttataatatgcacaggaataaattgaacattgaaaaggaatttaaacttaacatctgaaaccaaagaatccctagaagaaaccaggggaaatcctccttaagattgaccttggcatgattttttggctatgaatctcaaaatatagacaagacaaacaaaaataaacacatggaactacaccaaagtaagaggttgctgcacagtaaaaaaaaaaataataattaattaattaattaattaattaaaaaggtcacccatggaatggtagaaaatacttgaaaacaatatatctgataatggattaatatctgaaacagataagaaactaataatcagaaaaaaatcctgattagaacatgagcaagagacctgaacagacttttttccaaggtagacttgcacatggccaacacatgaatgaagaggtgcacaaaatcactaaacaagtgggaaatataaactgaaatgaaaatgagatgtcacattacatcttttaaaatggccaatataaaaagccaaaagatagatagtgttgacaaggatgtatcaaaacgagaatgcttatagagttttggtgggaatgtaaattggtacaaccattatggaatacagcatggagggtcctcaaataattaaagacttaccatatgatgcagcaattatacttttaggtataaatttatatacctgtgggtgtgttggctcacacctgtaattccagcactttgagaagctgaggcaggcagattacatgaggtcaggagttcaagaccagagttgccaacatggcgaatccctgtctctactaaaaaccataaaaattagccaggtgtggtggtgggcacctgtaatcccagctacttgggaggctgcggcatggagaattgtttgaacctgggaagcagaggttccagtgagccgagaacttgatgccattttatataattatcctttcacagacaaaagaaatctaatcactatcttgaagagatatctgcattcctgtgttcattgcagcattattcccaaaacccaaaatatggaaacaacctaagtgttgatagatgagtagtatgtgaattgtgatatctatcatctatctatctatctatctatctatctatctatctatctatctacaatggaatatcattcagtattaaaaagaatgaaatttggccctttgtaacaaaatgaatgaccctagaggatattatgctaagtgaaataagccaggcagagaaagaaaaatactacaggtacaaccatgcaaacttgccattataagatgaataagttagggagatctaacgtacaacatggtaacaatagataataataatgtatgctttaagttcatggagtgtagatcttaagtattatcctttcccaacatgtgataactatgtgaagacatgaatatgttaattagcttgatagtgaaaatcattttaatatatacttgatgggcgcagggtgagaggagagtgagggtcaaaacactacctgctggggactatgctcactagctgggtgatgaaatcatttgtacaccaaaccccagcaacatgcaattacccacgtaacaaacctgcacatgtacctcctgaacctaaaatagaagttgagaaaagaaaaagaagatatcagtttcctatagggagctccaggtttgttccaaacagtagagagacaaacctatcaaggatgaaatatatacaagagtaggcacaacttaaacaatgtgtgtaaggcaatcaattctatataactcagcaactcctaggcttcttatcaaataaaatcactgatgtgtcataacttctaaactaaaaacaacacaaatgcccattcacagtagaatgaataaataaattacttttgcttcccacaggggaatacggcacagcaatgaaacaatgatctgctgctacacaaaatgtagatgattcttacaaacttcaactgagtgaaagaagtcagactcaaaagaatacagatagcaactttccatttatatgaaattgaggagcagggaaatccatcgtgatagagttcatgataatgatgacctttggtgagtaactggttgagaaagtgcaagagagtggttgtgggagctggaaatactccatatcttgcttgatttgagtgatgatggggatatatacacttataaaaattataatgctatatgcttaagatttatgtattttactatttgtaagatatatattagttgaaaaaatgctgcagtgtaaaggaaaccagtaaaaatatgctacctagaattgtagatttgtttaacaaaaaagcatttgagtagtctattgattattagttagcaagtttatattaagcatcattgtcctgaatactttttagtatgtaccagtaagtgtttgcctttctcaactagggctaattaaaaaaaactcaaaacctcatgttgtacacattgaatatatataattttaacttgtgaattataccaccataaaactaaaaatctaattaaaatgagttcgaataaattttagggaaaataggataatgaaaattatgagcttaagaatatgcatagataaaaaataaactgttgatagaaattttattgttatatttcagaaaatcatataaaaagctgtgctaaaagtttccagagagagagtacatagttctcctgcagtggattaaaatgagattagcattggagtactagtctaaaaccacagatagagtctggagtcagatctcagaaatacaatatatttgataagtaatgagagacaagttatttaaatttttgggacctaaacatccagtctgtaagtttgttgaaaaaaataaacaggctaaagagaccttaatttacagggagggctaaattattacctattattgtaaaacataatagcagtgacattaaaagcttgagtgctgtagaacaatatattgaaaatcactttttgaagttatatacatatttatattactttaataatttgcacaatgtaggaagaaaagcttgctttgcacaggcaacattttgccaaataatctccaaatcatcatgaattctcaattagtcagattaacaataataaaattttattgtagaggaggattattttttcattaatatatttgtacctacacatagtgtatatgtaatattttgttacctgcctggactttacaatgatcaattcaaagtatccggggtgtccataacctcaagtattatttccatatgttaagaaagtttcaagtcctttagctattttggaaaatacaatacattgctgtttatatgtagtcaccttactctgctatgaaatattagaacttatgtcttccaagtaactgtatgtttggacccattaacaaacttttctttattcctcccacccacagaaactctttccagcctctggtatctatgtattattctattctctacctccatgagatcaatatttttagctttcacgttctattcttagaataagaacatgtgatgcttgtctttctgtgcctggcttatttcacctaacacaatgacttccagttccaaccgtcttgctgtaaatgataaaatttcattcttttttatggacaaaaactcttccactgcttgtatatataccacgttgcttttattcattcatccattgatggacacaggttgatttcatatctttgctattgtgaatagtgcaataaatatgagagtgtggttaactctttgatatactcatttattttcctttggatacatagctagtaataaatagcttgcacctctggtctcagctacttgggagactaaggcaagaggattacttgagcccccgaggtttagattgcagtgagccgtgatcacaccactgcgttccagcctgggtgacagagtgagaccctctccctcctcaaaaaatccttaagaaatatgttgatgcctggttcccttattcagaattttcatttgatgtgttgagagtgtagcacagaagttggaataaacctctcaaactgattttgatgtgcaaccaaggtcgggaaccaccaaggaagagtttttatgcataaagattcctatactctatcctagaactaatacatatgaatctctgggaatggagtataagactcggatttgaaaaggtgtccttagttattctaaggactgagcagtttggatactggtttgttagagtaaaatggttaggtacctagtatcaacctagccatctaaccttatattaacaactaggaaaataaagggttggagcctctgtgtttctttgctgaaaaatctgctgctattcttagttctatgaaaacaaattcaaaattcggttattatcaccttaaaagtacaaaacctatagatattgaaaatgcaattatttttctacaggcatagttaaaatgagtttgtatatattataaatcagtttctttataagtcatttatttagataaattttgttatactgacatgattcactaattttctaaatataaatggttcagctctcagttatttttaaactaaagagctgtgttatacttattatttctaattggcttttatgatgttttaggtttcttttgaatcccgtgtccttcaagtgctttccaactttgagaagaagaaattgaccacccggactatggaactgtgcgtaacagctttgaaagtgtatttaaaaattaaatctgtatgcctttaaatcagtgaattggaaatatattacatgtattttaatgactttcctcaaatacaataaattgttttctttccaatggaatggtgtttgtattttttctttacctggtttaacacatgtaggagaacataactagatgattacatcaaattctttttaaggcaattttataatatattttatttatgattacaaaaactgccttttaaaagttcttgcctggatatgaatgcagtttcacattttttaaattgtaatcttgctttttgtaattattttatatttgtctggcttcgagttttattgggttttagttttttggaagtgggggatttatcccaatttagaaatttgtatccttgccgtaatacagtctaccatttttgttctcccagatctttcatctgtcagaacatcactcaaaggtgaaaatatttcccacataaaattattcttttcctttagtgaaattagttccagctgtatatacgtaggaaaacattcttctttttattcgattcattcctataggtacgttcctgggtctgtgattacacctttaccttagaggcactgcccaaaaagactcaagtcttgtgtaaaaatgctgttgtggatcatagcttcctaccttttacagcatcgtgaggcagggagagtaagaacattagagacaggaattagaggcatggagaaatgaaccctggagcatcccaatggtgagatataaaatagttcaagaactattaaagaagactaaggaggaatagctagaagctaaatgaagaaagtatctcaaataggaaggagtgatcaaatattttagctgtgttgatgagttaggaaagatgagtttttggattaagcactgggtagagcaacctttgggacattgacgttgaccaacttggtggatatcaggagtaagaggaggtactcaagagaatgttggagaggaatttaatatagtgagtattgaagacaacacttaaggagtcttgctttcaaggggatgtgagaaatgggttgttaatggagggtaatatagcatcaaaaagctgtttattttaagatcgatgatatagcaggtttctatgctaatgggactgattcagtagacagaaaaagcataatgcaggaaacagagggatattgatgaagacatagacctggtaaaaaaatagaaggcttggttttaaagataggcacacaaacagctaattactaacagtaggatgtacgtcagattatggaggtccagatgtttgtagttcagtagataggaggagcatgtcaaatttttgtgatattttctcagtgaaataggaagcaagctcataaaaagggaagaaatcacgaaggattaaggaaggaaaaagagatgtaaaatgaatagctaggaatgtacaaaagtaaacaaactcttggcaatctgtggtttatttaagtggtattagtcaatgtggtttcgtgttcttttccagttcagttcagcagaggcgctatcactgaataagtacagaattcagtttaactaaaggtgagatttctctaggtgaataaaacagtcagtgatgagatgttcatacatttaggagaatgattataaaagagggatatggaaagtaatctgggttaaggagtgaagtgagaaaataaagaaggttgagacagtggaaaatggtatcatcaattgtagattgcagtgtggttgacgatgcaatggagttctcgaggtaggaactagaaatttgggagatttagataagagtgggttgattgaaattggaagtattagaggataatagtatataatagtactaagtatagtatactaagtatagtagcatagtgctaagtatatactatcttgtgagtataagttttaggatgtgaagatgggggtagcatagaggcaaagtgatggaaggagatgagttaaaggaattgagaacctaggagactgaaaggattatctaaatgaattttgaaatctcaacaagagctgtgctgagtgcttgtagtcattattttatgtttactactctgtgagaagacagcacttccttttgtgagtaatggaaagttctttcatgtgtcaattgtaagatactttattaggttcaattatctttagtaatgcatactaaaaaatagtgagctcagtgggattattcagtagatatgtgagctaaccccctctgtcagacacctaagaggtagaactgatggtcttcaagaggaatagagacttctcatcctaagtgtgtaagctgtgaaatatcccaccctatgttttctgaaaacaaacgttatatagagtgtccacataaaagctaacaggaaatctcacacacacacagacacacacacacacacacacacacacaaaacattgaaaaacttcaggaaagatataccctgtacccaacatgaacgaggtcaaagcaatgaagaaaaagctaggaaatcaaataagtctagaacaactgtgactaatatataaagatttgaggtggttatatccatttaaatggtatcaattagaaaggaaaaaaagaggccaggcacagtggctcatttctgtaacgccagtactttgggaggccaacacaggcaaatcaacctgtggtcaggggttagagacaagcctggccaacacggtgagaccccgtctctactaaaaatacaaaaatatttgctggacttggtgtcgcgtgcctgtgctcccagctgcttgggaggctgaggcaggagaattgttttgacccagaaggggagattgcagtgagctgagattgcgccattgcattccagcctgggtgatggagtaacatccaaaaaaaggtattttacataagaaattttattttatttttctgtaaattataaaatagcacttaatatggaatttatataccagaatctttgaatatccaaaatttaagatgagagcaattttgagaaacttttcaaagcttaggaaaaggtaactacataaaacaccattatgtgttatttatgggtacattagatgaagtaagtcacaaaaacacgcatagaaatgatcatataaacttgcaagaaattgaatgtcttgctattgaaggaaaggttgaggtgtaagagattgaggttgagtgtgagaagctctgtatatattgtatttttcttaaaaatatatatttaaactcacatttcttgtttttcaaatgttcactccaatgaaaattcttttacttttcctgttagaatttttatttccactctcacatatgcagtgtactattgttcagaaatattagtgatcctccttgcaaatgaatactcccatcctgctgattttcagaaggtccaagtgatttgctttggctgtgaaatgtaagcagaaagagtgttattttggggacttcccgattgcaaaacaacatagtatcgcaacttttgacatagcatttacgttgcattagtcattataagtaatctgagatgatgtaaaggttatatggaaatactacattttatataaaggactcgagtagttattgctttaagtatccatggtgggtcctggaaccaattcctcatggatatggaggcacaaggaaccactgtagttaaacaaataatcactttaaaacttaaaaccttttgcatggtgagtacagtcatgcaccgcatatatgatggtggtatagttaagtttattatgccatacatttattggaagtttcctatgtttaaatgtattgagatacacagctacactgctttacagttgcctatagtattcagtaaaataacatgctttacaggtttgtagcctaggaggaataggctatgcaatctaggttaatgaagtccattctgtgatatttgcacagtggcttaattacctaagggctttgtcttcagaacatactcctgtcattaaggaatgcatgagtgtagttggacaaaaaataataatgcaggcatacctttggcactgtcctaattcttaccaacatccatgattgcttaaatttgcactggaaagacttcaaaaaacagtgatatattaggacagtatatttccaatacatgacaaatgataacaacataagaactcaaaacattcaataagaaagaacataacaattaaagcaaaactagatgggaaaaggaagaagcaaatttcaagagaaaactcaaaaggccaaaaagtgtgaaatgatgttcagccttgctagtaattgggaaaaacacaaatctctttttttttttttttttttttttgagagggagtcaccctctgtcgccaacactggagtgcattggggcgatctgggctcactgcaagctctgcctcccaagttcacaccaccattctcctgcctcagcctccaaagtagctgggactacaggggcccgccaccatgcctggttaattttttgtgtttttcgtagagacagggtttcaccatgttagccaggatggtctccatctcctgacctcgtgatctgcctgcctcaacttcccaatgttctgggattacagctgtgagccaccgtgtctggcccaaatcatttttaatctattaggcaaaaattagagctatgataatattcatttttggtgggagtgtggcaaaaggtactataacagaatgctactagagagtaaactttgatacatttgtaagggcaattttgcataatatgaaaatttaaaaatatgcttccagtttcacatacgtttatctagcatacagaattacccatgtgtaaacatgtatacagatgttcattataacacttcttataaaaacaaaatatttgcaaatattcatatgaacaagtgcatacatatgatcttagtccagttagaattttctgttttatttcaatcctttaaaagactcaacttctgattctatataaacaattcaaaaaagaatgtgttttccctatgtgcatttggtcaggtaaattaaaaaatacacctcatgctagcctcacaaaactggaataagccttgggaaagaagttgtccttgaagcttgtatctgacattgtagcaggacgagccgcagaaaaaacctctcagacactgagttgtagaaggaagggctttattcagctgggagcattagccagctactgtctctaaatctgagctcctggagtgcacaatttctgtcctttttaagggctcacaacactaaagatttcacatgaaagctttgtgattgatttgagcaagcgaggtatacatgacaaggactacttgccccggtggtcagggagaaacagaatatggaagagagtttcacaatgttcttctacacaatatctggaatctgtgaatcacatcggcttctaaatcataagtggatgttcaactactgggtttaggccaaccaggcccaggtctgtttttgggcctggcgccgggctgcctgtctttggttttatttccttgttgtttttactgaatagaaaacaatgtaaaacaagaggagagggtctttctcctctctcattttctttctttgagactttcactcatttttattagtgggagctgtcacttttatgatttatgttcttctgtgcaatagattgatagccatttatattgtatgcttgtgctgaaggcttttggtgaaataagggagagacgaagttttttatgatttggagaaacacaggtatcagacaagggagcagtaagcaggttcctattactattattacctctattataagagttttaaatcctcctattgctgggaactactttctaaacatggctcctggattgagtctgtgccagccttgcacgagtacatgtgccagttttgttatatccttaagtatatgctcaactacttgttctttatcatctatgtgtaggcaacatgtttcgtcagattctctcgccaggcaagaacagtcaaggcttgttgggttttattagtaataatttctaaagcagcttgtaaccatatgagcatgtagataggggttggatatcctcatgagccatcttgtacttaagtggcgggtccatagtattgtatgattctttcaggggtgcattcatcatctttctaaccacttatggctatgcttcattttgcctgggaagcatagactgggaagcctacaagttcaactgtttttatgggcagtaagaagaaagatggcttcatggtgccaattacacagccacacgcccactggtcaggcagcttagcataagctttgtgtctacatatctagcataacctagtgggggccgtccagtcctggtggaattctggatgggcctaaacagtctgcaactttggaaatttgctgaatgcatttctttctgtgtaattggaactgtaccatgtaactgtttttgtggcaccattatacaggttttgcctaagacaaataagccgccttacgggatgagtaaatccttttctttctctagctacgcattactgtctaataattgtgacttttagaaactaaaaattgtcggggttgttcttttgggatggaattcgtgaggaactccatctgtaggaactaattcttgggcttcttatggccattgatctcctgttacagtccttccacaaacatcacatgaaatgacttgtagagactgggctacatgtttggctaattgcaaaaacaaatttttagtttttttcagaaatttcaggtataggcacattgaattcatcatagaaagtgtgaaatacttgtcctggtgagcgtttttgaacttcttcttttatcaggatgcttacactagaatctagtccttttctatcaatgcctaatgttatatattttcttttattccactttggatctgaggggtttgtgatgatcaattttaaagggttgcagctcccacttgtgcaagaggggctgacttttcttttttggagccaaacaggatcttttttatctttcttctaagtagcctaactgacgcaataccactattgacacatcgaacataaatatggttcttgacagatgtacttattttctgtgtgtaatttttcccaaatttagagaaatgcatcttatcctctgctgtttagtattaatagtggcacgagcatcaaattttaaagttacatttgtggggactcttctttcttctgttctagctatcactttacttgtgttacttagagaaggaccagttcttagtcttacttcgaagactgtgatcatgggggtttagaggggtcatagcacacatcgggctggtcacttcctggattacatacttagtactgggtgttattatacaaacaggttctgtttggagttcttaggcattcataatagctgtaaaataaaacgatcatcttaacttgtccttcttcagtgtcctgatgtatgcactgaaggcagtcctctgtgtgggaagaggtagtggaagcttttaccacacaggtccatgttataaggacaataagtcctacgacgattttcctcatgctttggccatgtgtagtctagtcagcttcgtggtgtgattggagcagggcttgtcattttcttcaaggtcacttttcagggattgtccaagtttggtttggcctcctaggtctcagcggctgcaggcttcatgaggctgtggtgaatctaggctgggattccttctacattgacagctgtgggagtggtcaggttaattgtctggggtcctttccactgtggccacagcggagccacgttccagtccttgatccacacaatgtcacctggagaaaaagggtgaactggggagaatcagctgcctgggcacctctcatttactcaagttgagatagtctgagtaattttccctaaggcctgtagctgccgctgtaatgcaatctcacctaactcttggggagtacctggaagccctcccagtatgggaggaggcctatgatacagaatttcaaagggggagtatgctgttctcttagaaggggtacacttaattttaaacaatactataggaaggacttgtgtctattttaaatttgtttcttgacatactttccagaaactttttctgatagttcgattcatttgctgcactttccggaactctaaggttggtaaacggcatgtaacttctatgaaattcttaatacctttgccgtcttctgtatcaagtcagcaacaaatgctggcctattatttgagccaattcgtagaggcagtccaaacctagggatgaaattttgaagaagtacacaggttacttcaggagctttttcagttcatgttggataagcctccacctacttagagtaagtaaacactagaaccagtaaatacttgttacttctacatttaggcatttctgtgaagtccacttgaagatcttcaaaatgagctgctccagaggcttctattccccgaggtacagaggggccttgcttcgcattgtgctgtccacaggtaaggcatcactgcgctactgttgtagcaacagctggcaagggtgagatgtagaaatactggcctaacagcttttcaagtgattcttggcctcaatgggtagtttcacatacagtcagcatgactgtatagcagcggtggcactgctattcttccatctggtaactttatgtatctttcctttattgtttgtcctctctctgtctgaaaaaattctttttcctctttagaataagttggcaccagatcaagcatttgaaggagtagcagggctgtgactgatgtctggtaaggagtagatgctgcttttcctgcctctgtgtctgctcagggctttccttggcaaaccgaagcggaaactcgctgatatcccctgcaatgcatgaatgccaccttttggggtttctacactgcttctaatcattgtagaatttcttgctgacattttatgtcttttcctctagaattttttccttatacaatgctccacatacttgaagggttagaaaggcatatcaagaatcagtatagatgtttacaatcttaggttcactgagttccagagcccgagttagaggaatgagttctgctttttgggctgaagtgctctgaggcaatggcttagcttcaacaacatcatctaagtttactactgcatatcctgcacacctttctctttgcgggttgatgaagctgcttctgtccatgtagaactcctaatctaccaatgcctatggctggtctcaaagatctggtctgctagaatagacatagtccaacacctctacacagttatgtttaacagggctgtctgatactgggagcaaagtggcaggatttaaagaattacagacttctatggttatacattgattttcacataacaagctttggtgtttagttaatgtagcatttgttagccaatggtgtcttttggtgttccttagagttacattagagtcagcttgggctgacataagtttttcttttaacttataagtcttgttgttgtagagacctctatttaaaaggctctcggtcaccccctttataactccattcaatgctttggctaacaccacaaagtttggaatctgcagtctgcaaaaatctcacagctcctaaatgttctcttatttgcctcctggttttaggttctggtaagctgcagatgacctgctttcttgctgaccatagactgcactccccttttcaaatagtgaatcctaggtagtgtacctgctgtctgcagatctgagctttctttttgggcactttatatccacagtcctccaggtgtcgaagcagggcacccgtcctttttgcacacctgactgccatggagtgtcctagcagaaggtcatctacatactggagcaggatgcaacctaggtctttagcaggaaacatttggaggtctccaaccgaggcctccccaaagatggtgggggactttttgaacctttgggaaagtcgagtctaagtgtactgaatggtgacatctgactccggatcttcctactgaaaggcaaacagcttttggctctcaggaactagcctgatgtgaagaaggcatctttcaagtcctgtacgggtcgatagtctttggtccttggtttagggacaggtaggaggtgggtgttccatggagactggcaaggaactagaattccagaggcttttaagcatataagatgagtctctattcctttaaaggcttccctgggaacaggatacggcttttgtccaattggctaggtcgtaggctaaacttctatgagtacgggggcttgattgattgccagcctcagaggattgtcctccatctctactcagagccgtcactcagctggagccacttttatttcctgagctggctcagttagcaaaagtctccactcttcttcctgggggactggaagggccatgatgactcctgtttctggcaactccagctgtaaagtgccttgttttgtcaaggaaatggtggctcttaacttgctaagcaagtctcttctcaacaaaggcaagggacagtcagacatatacagaaatggataaatcactttgtgtcctcccactgagcagttgcgcggtagacagaagtcctgcttggtagagactcctgttgctctaattctatcaatggtctttatagatgagggggccactggagtgcttactactgagtgttcggctcttgtatccactaaaaacttaatgtccttgccccttattgtcatcctgaccatgggctccttgggggcatttgagcctgttccccttaattctagcagcccctcagctagattgaacaaaatcctttcatcttggtttgaggtctttggctctgcatcactctgattttctttgagttggggacatttatctttctaatgtcctatttctttacagtaggcacattagtcatgctgcaaatgtgagtgattggacagggcattcctcccagaacccccttttttctgccttttcaggagaattcctctaattgtcacagccagcaaactagcgtttcacctggcctggcgttcgccctccttacggctttcttggccgcttgttgcatctctatttacaaatacttcattagctctttccagtaactgcaaggttttcattcctgcaaacctagcctgtttttgcaattttctctggatatcttctgcactctgaataactaaggccgtattaatcaacggctgattttcaggactctccagatcgaaaggagtgtacatgcaataggcctcacacggtctttgatagaactgggctgggctttcctcctttccttggatgacttcagaaactttatttacattggtacccttttgagccccttttttcaacctttcaattaatgcctctcggtaccctcttagcctttccatatctggtccttcatttggatcctattgagggtccgttcctggcagctgaattcttatgtattcttggggactttgataattggctgggatgtgctcctccagccatttaactgttgcctgcagcacctgttgccttttatgtgttttaaagaggtacatgagtagctggtggcaatcagcctaagtaggattctgagtctggataattctttgaagcaagtcaattagggcttgaggcttttcagtgtaagatggagtgttatttttccagttgagtagttcagcagaggtaaaagggtgatacacaaaagcatgcctttctaccgtatgtctgacctcatctgtcctagtatatcgctgctctctcagggcatttgaattcccgtcttgggccgttaagcgggctgccagggaagtggattttcccgcagtttcacttttgttcttgtctactctgggtggtctaggggctgtgggctcaggagaagggggcctccccactggataaggggttgagggcactgttggtgccatctcctgccttgagtcctcgagctctgggtcaaacagaactttaggtgctggcttctcttggccggtggagcgagaactttcctgaaataaatgtccctttgctactactactgctgctgcctgtccttttaccactgtagaggatctaaaactagctgtaactaggaatctctatatggaaattgatatgggtgcaggcacaccatgagcgatcaggccaagcttccgctcaggtggagtggggcaagttgaaaagacttgtcttactaagtttcagatgtctggactccaagtgccagttccttcctggtgttcagccactgtgttaatcctccgcggggatcactgctctggcgaggcgttcaaccggggccatttcctacctgggagcgctctttggatcccatccctcaggctggccagagtccctggcagcctgagggatgccccggccttactccacaaggcatgcctaatctgcctaaggagctgcctcggccgtccatcagttatcttgcttccaggtcagggaaccaagaaatgtagcaggacaagcggcagacaaaactctcagacaccgagttgtagaaggaagggtgttattcacctgggagcatcggatagctactgtctcaaaatccgagctccccaagtgcacaatttctgtcccttttaagggcacacaacactaaagatgtcacatgaaagggtcgtgattgatttgaacaagccagggatatgcgacaaggactacatgcacccgtggtcagggagaaacagaatatggaagggagtttcacaatgttcttctatacaatgtctggaatctatgaataacatcggcttctaaatcataagttgatttgtaactactgggtttaggccaaccaggcccaggcctggttttgtgcctttgattttgcttccttgttgtttttactgaatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaatagctaagtgtgtttcttttcttacatatacagtaatagttacatatcattaattttaaataaaagctctaattagtaaaaagaggtttaagacacttgatagtatgaaatacaattccaggttacacataagttatttattttggcaaaaggatgactcaaaaattttaaaactaggcaacaatctttactcattaagaggtaagacttagctttccaaacagtttgtctcctgtctactcttttctctccttggcattctaccaacaaggcaaaccaaatatttcattattcttctctattacatgaaaaatctgtacaagggaaggaaagccaaattttacccttacataggtttcaaaagaatcctttttccataggcaacatttacatttttatgcctttttataatcttttaccacaaacacatttaagtgttcctacacaccttgcatgtaaatttatttttagttgtcttatttacatatttttatggtcaatcttagcaatttttaactttaatgtaaacctggtaagttgttttaattatgtactagatgcagataaagtctgactttttccattctagttagggcatggttaatttcatatgtccccaggccttaccaagttgtaaagtaggcagcctacaaccttgaaatatttagcaagccttttatctaatttatgtgatttaaacctgctatttacatattgatgatatttgcattttccaatttgatctttaaaacagtttttatttcttagagtttaaaaacacataaactaaaaggcattacggttttaactttcctctaaaatatttgatttaagtgcttatttttatttaaggcaatcaattggtcctcgttacagacatcacacacaacacatatattgctacacagacaaacagaagaagatccagtagctctaagatttcttctcgtcccatttcctaattgcattactggcttcccagtagagccctttaagaacagggatagcaaaccacgaagtttctagggcctaatcaacttgtatagctgtaagacaaaaacagattttgagcaggattgatcagcctctagattctgggattccatgaggaaaacagaggtttctcccaaaatggaatccatcatgcattttctgtttttcccaaaacgtttcaggccaccagaagttatcttgtgtgcattaagagtggaaagacagagtggagaacagtaattcagtcaatggaaaagttcttttcaagaaaaacacgatccaagaagacaaaaacatgcaggtcttttaaatatacctataacttgaatatccacttttaatcaagctcagcaccctttcagaaaatcctttgacatcttctgtttcctgactttagctaaatcaagcaggtaatatttctggcttttgaattttaccaaaggtaacatcacaggggaaactaaaaactctccgttaggttataagttcaccgttagtatacaagatattttataagtggtggtaagcagcttttaccagatctagaacctttaaagtcagttgagagaaaggaagatttcagaaaggcagttagagtttttcatggcggagcacgagatgattaaacgtcacacagttgttaactggaaagtattcatcacccaggctgggattgaacctgggtcaccattgtaaaaaggcaacggctgaaaagtggtactaccacatggttacaggttatgcttaaggacataaaacaagtcggagacatgcagcaaagtttgttactgaccagtttatgagggtgtcttgaacagtgagctcaaggagtctcaggcctggattccattccaaggtaccctctgtctgactttttcttctattttctctccttttcctgagcctcctcctagtacgtcttatgaaagactgaggtggctactcttagaaggttttctaaggtgccttctagtcctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagagttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatattgattaaaaatcttaaatcaatatttgaaagttcttaaatatggatttgagtttcttaaagtagtcaaacttgttaacttctgtccctaagagatctaaattcctattttaaatgaaattcaattagctacatgtctacaagaaaaggcatatattactcttttattcagatcactctcgtaaaaaaattacctgagtagcatcattgtagttctcgatatctccacttccagttttacatttaccatcattgaaatcccatccagaatatgggactgctggaaagtccctacttccagggttgaagtaacttccacaggtactgcttgttcctgcactcacagcgttaccacacatatgattaattacagcatccacataaatacgaacctagaaaacaaagtttctacttcagtgtgacttacagagaggtagaaatttaaagcattattgatgcaagtttatagtatgttaataaaactccaaaatatttcatg

SEQ ID NO: 133 - DNA, 64952 bp, Homo sapiens
  misc_feature (4068)..(54067): n is a, c, g, or t
ttgtcagtttctaaatgttcctcaaataaaaagggctcctaacaaatctacagcgtctacgtggtctggctctacctatctgatattttggtgggtgtgtggggaaggttcttctcatgtttgtcttctagttttcattaatatctgtctctctccttttccccaaccaatgcgggatgacagcagattgctggtatactgcttactgctgtatctctaacatttatttaagtggcaaaaagaactgtaagaggaactctggttctccagactgtagcagctacatctagcataaaacctctctttagaatcctcaaggccctctctgtatggggtgaggggtacattcctgaccctccggggatgatccctgcctcactccattcagaatctaggcagaacagtggattagaatgtagacccccagtcagaacaccaagggtcaaaacttagttcttccactttctagctgtgtgatttaacctctttgtacatcagtgtcctcagctgtaaaatagggagaaaagtacctacacctacacacacacacacatacacacacacacacacacacacccctacacacacacacatacacacacatgcaataatttatttattaggttacctctccctagaggctgccatttctgcgaaatgaaccctggcaggggcctatccgtctgctaaatgcctactgattcaagaaaaaagtctgaactctcaacgttttgccccttaaactgagttctcctccctacaatggtgtctaatgagttgacagaataactggctagctttatattttaccatctaaatactgtaagaacatacccggtatttccacacccaagttctcctccttgctattcaggccaattcactttcccaaggccagggattaagagccgcacggtcagctccagatagcgctcgccgccgtgcgccccgccccgccgtgcgccccgccccgccgtgcgccccgccccgccgtgcgccccgccccgccgtgcgccccgccccgccgtgcgccccgccccgccgtgcgccccgccccgccgtgcgccccgccccgccgtgcgccccgccccgccgtgcgccccgccccgccctgtgacggtcccagcccgcacatgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactggtaagggcgcgcccctccggagtctcccgggaaggcatttgggaagtgaccggggagggggagcgctgacaagagtaaaatggaaacgagtggggaagatggacttgtgtgatgagagctcccccatcctacctcttttttatcaaaatatctgctctgcgaagtggagttttaatcggctcgagtctggattagtcatagcactgcagaaaagggcaagtgagaacgacaaagcagaagaatggaaattagcttagttatattgagttttcggatccatcctgagagcctcacaacttttttgaatttggggttatttctcctggactcaagagtattcttacaaatgtgcatcaagggattttttaaagtcctacttcatttataagccaatgttaaatcgttcattaaaatagaggagaagctacattggtgacttgcgtaaattaaatgcagaatttcaactagaaaaagaggcttttcataaaaatttcccgatgacatcttttagggaacaattttttagggctgttaagagtacctgtgtaggaatttacacaattactttgttttgctttatatccaaagatattttagatttctcttcattaaaataggaatagcgatggtgcaagactcagtggttttaaagtttccctaggtgattttaatgttaatgtgcagcccaagttgagagttactgaattagaagaaagaccaattttgatcagtttaaatgtcacttatgcctgcaaattaaaaaaaaaaaattatatatggctcaatttaagtacatcaggtcatcgtgtatcagattagacaaaattagaatgtgcgatataattattaaagtaacttttaataagcattgaccagagctcttccttagcatagtgattcttttactgttgatttgtgtttcttttctgatggtttttaaaatccgtataatttatgtttaaaaatagacttctcccattgaacattattacaaagataaagcacaaaggaaatatgcaccttgaagaacgatttctctgttggtgaatgtttttaaactacgcattgttatgtatagaggaaagtttaaaatctttagatctgtcataaatgaaggaaataaatttttagttggttaaaagtgaccctctgtgtagaacaggtctttaaacttttggtcttttgaactatttgcatgtgtaaaacgtgtgtctttatatgatagaggttgcatagctttcatctcaagtctgactcaaaaagtattgaaaaccactggactgaaattagtaatcagttaaatggtcttgagttttcatcctttcccgtgattttattaacatgtcacattactccactggtaaaaagtcagatttctttgtgagaaactgaaattatattggaagtaatttgtaccttaactctgtttcagaaacatacagcttttgccacattccctaatgaaaaagcagctataaaggtatgactttttcttgacgattaaagttgtcaacaggatcctcttatacaatcttggttcagataatgtttaactgtggtttttaagaagcaaaagcgtttgtattccaacagtttccccaacagactacatttgatttgtcagttggcagatcttgcccagtcctttagtagattatctataaagaaaaactaactgcgtatgtaattaaaataacaatttctaaatgatttagattgataaatatctctgtgactgttacaaggtaagatgtttcaagtgttaaaaggagaatatacatttctttataatgccagggaatcattcacaggaggtgatcttttagctagaagtctaatgattaattggattttttcagaaggaaacaagtggagatgggccttctgggcttgcagaacaccaaataaagctgtgagacattggaagttataagtggagcaggagctaagggttgagatggaaatggaacttgaaaaatagatttgagtctgggagagaggtattgagtttggtttagtaggtggacacttgatacttttgagctggctcataatatgatcaggcctgttaaagatatctggtatagttcatatcatggattggatgtgcagaattattagaggtaggagaccaaatggaaggctgttataatggccaaggcaagaataactatctgaagaagacagtaagaagacaaagggggaagtaaatatatattcaatagagattgagtttgtaggttttataatataggggttgagagagaatagttcaggatatttagattgaggattgagttatttgggttgttatattagctgacatgaggatccagaggatgtttgcaaaggcataggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcactatattaggaatttaaaaatttggtttgtgtttctgactttagatcttagctatctgctttgaagagtcactcactgtctctggacatcacctgtaaaattatggttttaattagataatcattgaggttcctttctactccgaagttctgtaattgcttataataatataatgaactctaggccaggtgtggtggttcatgcctgtaatcctagcacattgggaggccgaagcgggggggatcacttgaggtcaggagttcaagaccagcctggcctatatagtgaaaccccatctctactaaaaatacaaaaattagccaagcatggcggtagacggctgtaatcccagctacccggggggctgaggcaggagaatcgcttaaacccaggaggtggaggttgcactgagccaagatcacgccactgcactccagcctgggcaaccaagcaggactctgtctcaaaaataataataatcataataataataatataatgaattctataattgcttataactggctgttaatcctttctatttttccattcttggttatgtagtagtagttgtttttttaatcacttgagcagatagtgccagattgtaaggaacttaaaaaattgagataaatagtaatttaagaagtttgcagccagtgcggtggtccacgcctgtaatcccagcactttgggaggccgaggcgggcagatcacgaggtcacgaggtcaggagatcgagaccatcctgactaacacggtgaaaccccatctctactaaaaatacaaaaaattagccaggcgtggtggcggacacctggagccccagctacttgggaagctgaggtaggagaatggcgtgaacctgggagatggagcttgcagtgagcggagatcatgccactgcactccagcctgggtgacagagtgagactctgtctcaaaaaaaaaaaaaaaaaaaagaagtttggttttctagttgctaatagtataatttttaaatcacatacttttatgatagttgagaatagttaaaagtatatcttaaacaaatactacctacttgtagaatcaattttagtgcagaacatgaaatatatttttagaaaactgaataattgacgtgcctatcaaatagtgtagtcacttttatttgaaatagcaaaatgttagattattcaacacattttcattcacattgaaactgacattctttgaatcaaaactgtttcttccttctaggtttgatatacgtttgatgaaagaaggtcgtatgaaaggacaagctttcattggacttcctaatgaaaaagcagcagcaaaagccttaaaggaagctaatggatatgtgctttttggaaaacccatggtggttgtatcctttaaatccatctatttcaaaactatataatttttagaaggatataactgaaattaattttcatgttaccctttagaaatttccacaattggcattctagcagtagatattcattcgttacaattaaacccaccttactgagtcagatgacagtgttatttagatttttaataaaagagcttcagcagcatgaggttgttcaatttcagccaagtttaaatgtttcacttatgcagctcaaaagtacataggcatgctaagagactagagtatccagaagtacatttggagtcataaaagaactaattcattttatcattttattgtaatttatatttctacatgagaattttaataactagagtatatcattgattaaccatcttgcttttagtagtcaatgcagtttgcaaactagaaatcagcaagataggtaaagaagcaaaggcccaggtataaaaaataatgactgtaaaggaaaagttaattattaatttcctctcaagtcatgaagagaggcaggaggcactcaaggtaaattaaaaaaccatactcccaccatacactagaaagtttttgagaattatttagaaaagattacttgcatattcatgaaggaaaccttaattttaaattattagcagtttgctcgatctgctagaccaaaacaagatcctaaggaaggaaaaagaaagtgttaaaaattaataaaggtaagtgtgaataaaacataataaaaagacaagactaattcttgagataaaattaagaataaaagtttgacaaggtagtaattcaggtatctctttttttttttttttgaggaaatacctatctgtgcagttaagtcccattaaacgtcaaaactataactacagattaaaacccatttatatgtgaaaattaagtttggagaatgaatcttataaggggagtgtgcctgttactctttttttaactttttctgcctatagtaaagcaatggttcttaaaccctaatatgtatcatatcacttggagagcctaataaaacacagattcgtaggttccttccttccctgaaagagttgatttggtaggtctgatgtggggacctagggaaactgtttataccagttttccttttaatgaggggatttccaggatgctggacatttagtgctgaaatggggaatgtgtctggtaagccaagacaggtcggtcacccttgttggcacctgaaaatttgcgagattaatgaggtttcaggtaatgatgaggcatcttatccagagaccacagcttgaaaactcctggaataaacacttacagatacattttctaactcttaaaattaacctaaagtaaatgttaaaataaaagttaaaaaaaaaagtcaaactgtcattaaaaataattctggctgagcacggtggctcacccctgtaatctcagcaatttgggaagtggaggtgggcggatcacaaggtccagagatcaagaccatcctggccaacatggtgaaaccgactctctactaaaaatacaaaaattagctgggtgtggtggcgcctacctgtagtcccagctacgtgggcggctgaggcaggagaatcgcctgaacctgcgaggtggaggttgcagtgagccgagatcaagatcacgccactgcactccacactggcaacagagcaagactccatctcaaaaaaaaaaaaaatctacagtgctgagtatataaaattattaacacatttcacaacaatatgtgtttgtggagttaaatattttttgtctttaaaacaggtaattttagtgcatacttaatttgatgattaaatatggtagaattaagcattttaaatgttaatgtttgttacattgttcaagaaataagtagaaatatattcctttgttttttatttaaatttttgttcctctgtaaactaaaagaacacgaagtaattggtcacaattactggtgtttaactgccaaatatgggtaaataagggaaaattttgtttaatatttagtccttctgagatggcttgaatatttgaattttgttgtacgtctatactgggtagtcacaagtcttataaacactttagaggaaagatggatttcagtctgtatttttaaacatcatttattttaaatctggtgctgaaaaataagaaaaaaattaaactgcattctgctgttcttctttagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaatagtgtttgtattttttctttatctggtttaacacatctaggaaaacataatattataaaaaatatatataatttgtaatataatttttttatgattacaaatactgccttttaaaaattcttacctggataccaaagcactttcacattttttttattgtaatcttgttttttgtaattattttatatttgtctggctttgagttttactgggcttttggttttttggaaatgggggtttatcccaatttagaaatttgtatccttgctgtaatacagtcttccatttttgttcccccaaatctttcatctgtcagaacgtcactcaaaggtgaaaatatttcccacataaaattattctgttcctttaatgaaatgagtttcagctgtatatacgtaggaaaacattcttttttgtcaacttgacgttgacaaacttggtggatgtcaggagtaagggtattcaagagaattttgaagaagaatttaatatagtgagtatcgaagacaactcttaaagagtcttgcgttcaaggggttgtgagaaatgggttgttaatggagggcaatgtagtatcaaaaagctgtttaagattgatgatatagcaggtttgtatgctaatcagactgattcagtagagagaaaaaacataatgccggaaagagagggatattgctgaagccatagacctggtatacaaatagaagggttcgttttaaagataggcacacaaacagctcattagtaacggtaggatgaagggcagattatggagttctagatgtcggtagttcagtaaataggagcatgtcaaatttttgttatattttctcagagaaataggaaacaaggtcataaagagggaggaagtcatgaaggattaaggaaggaaaaggagatgtaaaatgggtatccaggaatgtaggaaagtaaacatactcttaggcaatctgtggtttatttaagtggtatcagtcaatgtggttttgtgtttttctccagttgagttcagcataggtgctatcactgaaaaagtacagaattcaatttaactaaagttgagatttccctaggtgaataagacagtgatgagatgttgttacatttaagagaaagataataaaagagagatatggaaagtaatctgggttaaggagtgaagtgagaaaataaagaaggttgagacagtggaaaatggtatcatcaattgtagattgcagtgtggttgaagatgcattggagttcttgaggtacaaactagaaatttgggagatttaaataagagtggggtggctgaaattgaaattagagtataataatatataatagtactaagtatagtatactaagtatagtataatagtactaagtatagtatactaagtatagtataatagtactaagtatatagtacttagtgattataagttttaggatgtgaggatgggagtagcatagaggcaaggtgatggaaggagatgaattcaagaaattgggaacctaggagattgaaagcattatctaaatgaattttgaaatctcaacaagaactgtgctgagtgctttttgtaattattttatctttactaccctgtgagaagacagcacttccttttgtgagtaatggaaagctctttaatgtgtcaactgtaagatactttattacatttaattatctttagtaattcatgctaacaaataatgacctcagtaggattattcagtagatatgtgagctaaccccctgtgtcagacacctaagagatacaactgatgattttcaagaagaatagagttctcatcccaagtacttaagctgcaaaatgtcccaccctatattttctgaaaacaaacggtatatagagcgtccatttaaaagctaataggaaatcttaaagcgtgcgcgcgcgcacacacacacacacacacacatacatacatacatacatacacacaaaacattgaataagcatcaggaaatatataccctgtacccaacatgcacaaggtctaagcaatgaagaaaaagccaggatatcaagtaagactggaacatctgtgactaatatataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatg

SEQ ID NO: 134 - DNA, 3913 bp, Homo sapiens
ggaaacaatgtcttttaacataagtatctctggagccacaaaaatttcttaagatgtccctatagctcactctattcccttgacctactttggagatacaggtcattagaaatctcatactgcatctacctcaagctgtcagggagtgcaaacgggaagtgcattctggagtaagctgctgatttcttttccatcactctttctttctatagcaattattttctcctgagccattaggcattctctctgtggtgtgtgttctctgcctccaggacatcatctgatggcgagttaacaatgtgaccccctgaactgggcccctcgagaagggccttccacaatgctcttgtctctctgggcttcctcctcattaagtacaacccacttcccaaaatagaaaggatcccactcatggatatcccatggacagagctgtcagctttgctgcctctcatcactctagtgaacaaattatcagtacttggagatgagcttgaagatcactttttactccctatctgattgtagacaaagcaaagcccctggcacaatctcgtcctttttcataccttagaggagttagtaaatcagtgaaggctgagggtttagtggttcatatcatgacaaaactaaatcctgtgtagctgtatcaaacattggtggggtctacaaaatgattgttttctttttcttattttaacaagttctagacaaataattattcatctagcacccactacctgtctatgctggttcccatgttcctcctctgtggtaattctgtacccctgtttctcttagttcttgggtggtgttgggaaggcttgtagtgcctccctcatttcccaggatctgtggtgaaagagctgaactttccattctttctccataaacaaaacaatcatgtctatgaggagtcttgtctccatcagaccatccaaactgacgtgcacatgaaagtataaaagatctggaaggggaggagcaaggaggtgtgtcaactcatacttaggactgtgagtcaggatattttgtgtggcttagacttcttcctgaaaagcaggataataatcagagaaaagtaacaaaatatcttcatttttctttatagtaccatgtatctcgttggcaacttatggcaatgaacttaattcaattaaaactataatttttaagattagtttataatttaaaatttttttaaattataaatttttttatattttataaaatataaataggcaggagaatggtgtgaacccgggaggcagagcttgcagtgagccgagatagcgccactgccgtccggcctgggtgaaagagtgagactccgtctcaaaaaaaaaaaaaaaaaaaatgaccctgacccacacaaaaaagctctaaaattatagttttaaaactataattttataatttaaaaaatttttaaagtgtgttggcatgattggcttcactatttatatgtcccaaccgttgtgtcaggcataaactagggtttgagtgactttaaaacactgacttcctggagcctatattttggggactaagaagacatagaaagaggtgattaagatgcatccctctggctgggtgcggtggctcacgcctgtaatccaaacactttgggaggctgaggcgagtggatcacctgaggtcaggagttcgagaccagcctgaccaacaaggtgaaaccctgtctctactaaaaatacaaaaattagcctggcaaggtggcaggtgcctatagtcccagctactcgggaggctgagaattccttcaacccgggaggccgaggttgcgctgagctgaaatcacaccactgcactccagtctgggcaacagagcgagactccatctcaaaaaaaaagaaaaaaataaataaagatacatccctgtaagaagcgtttgggacagcagggtactgtatgtgaaatggctgacagtggccttttcctcttctgttgtgggatttcccaggccctcattgctgcctttgatgctgttttccatgcaggatggcacgtacgggctgaactgtgctgagcgctgcgactgcagccacgcagatggctgccaccctaccacgggccattgccgctgcctccccggatggtcaggtgagagccaaggaccgctaattgaaaggtgaaacccgccaatttaacacctagtgctgttccttatcacttcacagaaacacacaccagtcaacttttcaaaaaaaatgaaaattcgataaggtttccagtaaactgaaacctttaatctataatccaggactgattttttgttgatttgtgtaggggcagttctcttgagctacaagtaaggtccagctgtcaaaattcaggccagcaagatggggaaaatgtgaattgctttgaagagttcagcaagaccactgtggtatattttgagcactgaagaaagaatgattgaaataaaccctaaaaatatgacaagggtcaccttagtgaggcaaaaaaatacagatattaatatggtgaatatgcatatgcatattattgtatggttaatatgcaaatattaaaatgttcattgctggaagtaaaagttttaaaactttctttttttacgataatgttctggtcatgacaaattcataatatgactgagtacaaattctgtaaccacagggtgggagtttctccttatttatatagcttcaccgtttcagccaggaagtttatcaagctaaaagtgatactgaaagaagaagtttctgctcatggtatacagacttgctaagatatttagtgccaccttccaagtatcatgagcaaaaacattgttcttcttctaggactactttacattcctaccagtaatgtacgagggttccatttttttcatttcctcaccaacactagttattatctgactttttgattctagccatcctagtcagtgttcagtggtatctcattgtggttttgctttccatttccatgatggctgatgatattgaacatctttctgtgcatttattggtcatctctattatcttctttatataaatccctgctcagactctttgttaattttttaactggattttctttttactatggcgttataatctttatattttttagatatatgtccttatcagatatataatttacaaatattttattccattctttgagttattttttcctttcttgatgatgacttttgcagcagaaaagtttttattttgatgaagtctagtttatcttttttatttcattgcttgtgcttttggtgttaaatgtaaaaaaacattgcctgatccaaggtcacaagatttatgtccatgtttctcctaaaaattttatagttttagcttctgtatttagatatttgatccattctgaggtaatttttacatacaatatgaggtaggggtccaacttaattcttttgcgtgtggctatccagttgtcccagcactatttgtgaaaaggctattctttcccccactgaattgtcttgataccctttttaaaattcagcattccataaatgtgagaggatttatttctggactccgtatttcatttcatttgtctatatatctctccttatgccagcaccatacagttttgattattgtagcttaggaggaagcattaaaactgagaaattgaaatccttttaaattggtttttctttttcaggattgttttgactattctgggtccttgaatttccatgtgaatggtaacatcaatatgttaatttccacaaagaagcaaggtggaaatttaatggagattgaatctatagatcaatttggggaatactgtccacttaacaatatgaagtcttcagattcataaacatgggatgtcaccagcaacctcttcagtagtgtctctcagccccttggaaaatgttgagagc

SEQ ID NO: 135 - DNA, 1182 bp, Homo sapiens
ctgaaagaagaagtttctgctcatggtatacagacttgctaagatatttagtgccaccttccaagtatcatgagcaaaaacattgttcttcttctaggactactttacattcctaccagtaatgtacgagggttccatttttttcatttcctcaccaacactagttattatctgactttttgattctagccatcctagtcagtgttcagtggtatctcattgtggttttgctttccatttccatgatggctgatgatattgaacatctttctgtgcatttattggtcatctctattatcttctttatataaatccctgctcagactctttgttaattttttaactggattttctttttactatggcgttataatctttatattttttagatatatgtccttatcagatatataatttacaaatattttattccattctttgagttattttttcctttcttgatgatgacttttgcagcagaaaagtttttattttgatgaagtctagtttatcttttttatttcattgcttgtgcttttggtgttaaatgtaaaaaaacattgcctgatccaaggtcacaagatttatgtccatgtttctcctaaaaattttatagttttagcttctgtatttagatatttgatccattctgaggtaatttttacatacaatatgaggtaggggtccaacttaattcttttgcgtgtggctatccagttgtcccagcactatttgtgaaaaggctattctttcccccactgaattgtcttgataccctttttaaaattcagcattccataaatgtgagaggatttatttctggactccgtatttcatttcatttgtctatatatctctccttatgccagcaccatacagttttgattattgtagcttaggaggaagcattaaaactgagaaattgaaatccttttaaattggtttttctttttcaggattgttttgactattctgggtccttgaatttccatgtgaatggtaacatcaatatgttaatttccacaaagaagcaaggtggaaatttaatggagattgaatctatagatcaatttggggaatactgtccacttaacaatatgaagtcttcagattcataaacatgggatgtcaccagcaacctcttcagtagtgtctctcagccccttggaaaatgttgagagc

SEQ ID NO: 136 - DNA, 9876 bp, Homo sapiens
aacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgctatggatatttcattgtttttcttttaaatttatttattttaagatgggggtctccctatgttgcctaggctagattcgaactcctgggctcaaacaatcttcctgcctcagtctcccaagtagctgagaatacaggcatgtgccaccacacccagcttgtttttctatttcatttgtttattggtgggagggggtttctacacccagctggatgctgcctggagcccatacacctggtcattggtcagttgtgtggtttttttttgtttttttttttttgtttgtttgttttttgagacagagtcttgctctgtcacccaggctggagtgcaatggcgcgatctcggctcactgcaagctctgcctcccaagttcatgccattctcctgcctcagcctcctgagtagctgggactacaggtgcccgccaccacacccggctaatatttttttgtatttttagtagagatggggtttcaccgtgtgagacaggatggtcttgatggcctgacctcatgatccgcccaccttggcctcccaaagtgctgggattacaggcgtgagccaccgcgcccggccatgttcagatgactgattagcctatcaaaggcattcttccgtttctttatggtggctttgatttctgatctttccttctgattctttgagtctctatttttctgctgatgatgtagggcagatgagcccccaaactgggggttagcccaggagggttcttggctttgctcaggaaagaattcaagaggcagccagcagtaaaagaaattgggtttattgaagcagcagggcacagcagagtggctgccccttgtggagcagggctgactcataggcagtatacccagggtagcagcatataggctgttggctagcagtatttatacccagttttaattacatgcaaattaaggggtgggctattcagacagcactcctcattcaccttccaccatgattgtgaggcctccccagccatgtggaactatgagtccattaaacctctttatgaattaggcagtctcaggtatgtctttattagcagtgtgagacacagttgctccggcctataaatgacacatagttttaagtctgtttcctgcagttctcctatgattggccagggttttgattctgttttgtttttttgcattttcaaattaagggtagatgattctgagggtcttgctccagctctgtctcaggcccccccaccagctatccctctttcttgcagtttacctaacagagccttggggtgggcatgtgtgggaccgtggtgctaagatttaatgctttttctcattttactcatagttatgttgcaattttggcattctctatgtcttaaaggcagtgttgaaggtatagttttgtgtagaagattcataggtgtggagttacttcacagcatttgaaaggggatttggggaggttgcttaccactcactggccattgtttttagttacctggaagtctcctcaccttagtttttggagatactttggctgaatatgttattttattttattttaatttattttttgagacagagtgtcgcccaggctggagtgcagtggcatgatctcagctcactacaacctccacctcccaggttcaaacgatcttgtgccttagccacctgagtagctgggattataggtttgcaccaccatgcctggcaaatttttgtatttttagtaaagttgaggttccatcacgttagccaggctggtcttgaactcctgacctcaggtgatctgcctgcctcagcctcccaaggtgctgggattacaggtgtgagccaccgcgcctggtctggatatgctttaaaggggtcatttctttgtcttctggcctccattgttgctgactaaaagttagcgttattcttaacattattcccctgtaagtaatgtaagtaatgtgttgcttgtcactggctcctcttcagataattatcttgggttttcaacagtttgactctgtgtcttggtgcagtttcctgtgcatttactctgcttggggatccttcagattcttagatacgtgagtcactgtctttcacaaggaagtatttggccattatttcttcataattttttaattgtggtaaaataaacataacatgaaattcactgggtttttttgtttgtttgtttttgttttttgaggcagagtctcgttctgttgcccaagctggagtccagtggtgcaatcttggctcactgcaacctccacatcctgggttcaagcaattctcctgcctcagcctcctgagtagctgggactataggtgcgcaccaccatgcccagctaatatttgtatttttagtagaaatggagtttcaccatgttggccaggatggtcttgatctcttgacctcatgatccacctgcctcggcctcccaaagtgctaggattacatgtgtgagccaccgcgcacagccccattttaatcattttttaggtgtactgttcggtggcattaagtacattgacaatattggctaccaccactatccattttcagatctttctcttcattccaaaaaattatgtacccattaagcaatcactcctcaacacttctatcttcagcccctggtaacttgtaggtagtgtccatgaattttgtcagaagtagaataataaaatacgttgttttgtgtgcgtctgccttatttcattaaaagtaatgttttcaaggcttatccatgttgtagcatgtatcagaatttcattcccttttatggcttaataaattctgttgcatgtatgtgtcacgttttattcattcatctattgatgaacatttgggctgtttctacctcttggctattgtgaatcatactgatattgatgatttttttttcttttttcttgagatgcagtcttgctctgttgcccaggctggagtgcagtggcgcgatctgggctcactgcaacctctgcctcctggattcaagcaattatcctgcctcagcctccaaagtagctgggtactcgccgagtagcctgccaccatgcccggctaatttttgtatttttagtagaaacggagttttaccatgttggtcaggctggtcttgaactcctgacctcaggtgatatgcccgcctcagcctcccaaagtgttgggattacaggtgtgagccactgcgcccagcctgaagacagcattcttagcatgaaggatgcaaagttgaggcaaaggagatctatccaaaccaacctcattacactacggcttctgagccacttctctacctgattaaccaccctagcccacacccttggttttatcccattagcgcagtttacttgtctgtccaattcagtttataagtgtttggctcttaactgcttttctggcttgtttccttatgaggaaccccatgccacataaaactttcattaaacaaatacatgtgtatgctttaatcttgttaacctaatcgtatgtcggtgtaattatcaggcccagcaaggatcctaagatgatgaaggtgaaatcttgttgcccctacaatatggacattggatgcaagtgtctgtgtgagttcctgctttcaattctcaggaattttccgaagttgttttcttcctcattttctccttttgggactccagctgcgccacaggactctgaagttcctgtttcatttttctaatgtgtttgttttccagtttgtatgacttctactgatatatcttaaagttcactaactcttctgtcctcttcatctgtggaatccatttagtgactccttaaaatccagatgtctgaggtccttaggaaaacaggtgcttctccctgttgtagcttgaatttgctctgaatgtggtggtcccctaagccaataacacaatgcctcctggcctgccctggccacccagggaggaatgaagggagaggtaggtgtagtggtaataagccttgctgtgcacagctttgtgtaataactgaaaagggtgatgtgttttcctgctcccatccccaagcctgatttcttcaagatgcagtaactgggacgggtgcagtggctcatgtctgtaatcccagcactttgggaggccaaggagggaggatcacgaggccaagagttcgagatcagcctgaccaacatagtgaaacctcatttctactaaaaatacaaaagttagccgggcgtggtggcgcgtgcctgtagtcccggctactgggaagctgaggcaggacaattgctcgaacccgggaggcagaggttgcagtgagccgagatcacaccactgcactccagcctgagcgaaagagtgagactcggtcaaaaaaaaaaacaaacatgtagtaactgacaccccccacacatgccctcccctccacctcctgttatttcattagaaaccctgccaaggaacaaggaaatcctacaaagaaggtgtctcaggtacccatcagcagccatgcagtgatgacaagtgggtctgatgccattaaaaggttgttttcaaaccaccttctgttgcaagcagaacccaattgcacaggaatccaagctccatgatggagctttggccattgtttttagttaccaggaaggaaaatggcaagattgagattaagcctggaggcccggcggggacctcatggctgtgaagaccctggactcctgtgttgctggagatagtgtttgtgctctcacatggtctgctcagccgtctttctgccattcagcacaacggaaggacctagtgtgtttccagggtgggagcctacgagtggtggactctgactttgacattcgggacagatttattccttaattttcttccttacatacttggttcatctgagggcctcagactccctctccaacagccttctaccctctcccatttccacattttcatttttgagcttccttagctaagtggttttactttcttccctttccatctctctctctctctttatatttctttctctagatttttaaaattctgtctctctcttttctccaatttctccatttccctcttttttttttttttttttttttttttttctttttctaagtcagggcctgactctgtcgcccaggccaagtgcaatggcatgatctcagctcactgcaacctccacttcccaggttcaagggattctcttgcctcaccctccaaagtagctgggattacaggcacacaccaccacacccaggtaattttttgcatttttagtagagacaaggcttcaccatgttggccagactgatctcgaactcctgaccgcaagtgatcctctcccattttggcctcccaaaatgctgggattacaggcgtgagccactgcgcctggccttacattgttattctgcacacattggccattgcgggcatcgttccttacctgagtgaacacatccatgcattcctaatatgtgtgtcctgggaaacctgggtttggagtttggagtttggagtagagaggccaagggtttgcagtcaggcaggttacttgcaaaatatttacgtatcagtcagatacattggctcatgcttgtaatcccagcagtttgggaggctgaggctgggggatcacatgaggtcaggagttggagaccagcctggacaacatggtgaaatcccgtctctactaaaagtacaaaaaaattagctgggcatggtggtgcatatctgtattcccagctacctgggaggctgaggcaggagaatcacgtgaaccagggaggcggaggttgcagtgagccgagattttgccactgcactccagccttggtgacacagcgagactgtgtctcaaaaaaaaacaaaaacaaaacaaaaaaaaattatatatatatatatatatatatatattatgtattgtgctaagtttcttctttgtaaaagcccttgggggactgttaagtgtgtgtctcagcttggatttgggtttttttagaccagagatccctggtccctttggaggtgtgagtatgagggtatttgtgtctcttgagaaggtctaagagttgccatcagtttggtggcagggtatgttgtacttagagatcttgtcagaatggataactcattttacctccatcacttacgaaatgacttttatcagctacattaaaatgctagcaatgtcatactacattctcataaatactgggaattaactaatgactttcttgtccaggtatttataggctttggcaaggcagcagtacacaaaactggtcccattcatagtaatcttgacgttaaactttggagccagagtacaagcgaataaataaacactaggaagaaaagtaaatgcggagaagaataaatgctgtgaggaagagtaaagttgaggaggggaacagacagatgggattgacccgttcaacctgtgcagtgtacagcgtatactcttttttttttgagatggagtctcgctctgtcgccaggctggactgcagtggcggcgatctcggctcactgcaacctctgcctcccgggttcaagcggttcgcctgtctcagcctcccagatagctgggactacaggcacctgccaccacgccctgctaatttttttgtattttagtagagacaggggcgtacactcatttttggccactttacctttttaggaaacaaaatcatcacagaaatcctcaagaggcagctttcctgtacatttcagtttctcctaaaacagaacagggctgggaatgcttactgaggaatcatcaaagcatttctttctgtcatgacaagagcaattccagcttgctccatgagaccctgcttctctcactgtatttggttttcaggttgcaagatttgaagaacacttgtcaaaactcgacggttatttctgttttcaaggactgtttgatctgcattttcttccagtccattcatttctatctggtttggcctccaaggtcttaatcttttgcccaagaaaacgcttacatttaagcaacatgagttccttgatttgtctgtagcccaatgctactttcttgagttcagaataaaagctgattattattattatttattgttattattattttgagacagagtcttgctctgtcacccaggctggagtgcaatggtacgatctcggttcagtgttacctctgcctcccaggctcaagcaattcttctgccttagcctcaggagtagctgaggttacaggtacccaccaccatgcctgacaaatttttgtatttttactagacagaattttgccatgttggccaggttggtcttgaactcctggcctcaagtgatctgcccacctcggcctcccaaagtgctgggattacaccagccttgggacttgacagtttttttttttttttttaagatggagtttcgcccttgttgcccaggctggagtgcactggcgcgatcttggctcaccataacctctgcctcccaggttcaagtgattctcctgcctcagccttcctgagtagctgggattacaggcatgtgccaccatgcccggctaattttgtatttttagtagagacggggggtctctccatgttggtcaggctggtctcgaactcccaacctcaggtgatccgcctgcctcggcctcccaaagtgctgggattacaggcgtgagccaccatgctgggcccttgacagttattttgacctaacattggtgataatttttctctacctcaaccaagaagatggcggattggagcacttttttcatagattgaccagtcttcccaacaacactggaggccagtcatttactttctgcagagaaagagacatgtcaaagagtcaacttaccagctggaaactgggactagtgtcaagtgcttactctgacattcagctcttgtttcacctcttgacccctttcatgcctgcatcaaccagtggatctgctgggctcagagcacatgacaaaggggcttgtggtgttccacttggcttcctgaaatcccttcctttcccctggcagtgcttccacgcaggactttgagtgtgtagtcggggcagtttacatccccaagtgaaaatgctgaacgttcagcaagccttggtcaaaagttttcctaggctcactagtgaagaaatagcaattactcactggctattgccaggattgagaaaaagaatgtgtaccctagaggccgggcccaaggggaagagagtactttctctcagcattgagtaaaatcggccattttttaaatgagccttgggaaccagcataactggtccctttgtgcccaatttctccatcccgataatgaattccatggataacctcagtggcccatgacagttgcctctcattgcacttccctgccagttctcagaaagaaagtgtcacacagtctctggagggaacttctaattacaggaacacagtctgcttgtctgagtcttgttttcagttcttggaccctctccagcagggaaaatctctgtcttgtgtaacctttgggtaacatccaatccactcaggaattcttccctgctagggaacctattgtatatacccaatgaatattagctaagtgccttacacttttaattaggttttgggaagaaagatcaataagacaaagtactgcccttaagaaagtaaaggtctaggagaagagcgatattaacagtaaataagacacctagtatggcaggtgaatccatttgggaggccccagatgaggaagatgttgaactgggggccatcaagaaaatctaagtagaagagatgatgcaagctcagtgtagaaggatgattatgattgtgattatgattatttggagatggagtctcgctctgttgcccaggctggagtgcagtggcgcgatctcagctcactgcaacttccgcctcccgggttcaagcggttctcctgcctcagcctcccgagtagcagggactacaggcacacgctgccatgcctggctaattttttgtattttagtagagacaggttttaccgtgttctcaggccagtctcaaactcctgagctcaggcaatctgcccacctcggcctcccaaagtgctaggattacaggcatgagccaccgaggcctgccttgtagaaggctcattaagagttcaggagcagaatcaaataagcatgctaatcctgagtgcaaaggcactgaaaaaatgacagtatattacattctgtagataaaagacaatctttggagtaagaggcagacttgaaaggtaatatgggacagattggagaacacacacatttcctttattctctctctttttttaaagactcggtctcattctgtcacccagattggagtgcagtggcatgaccatagctttctgcagcctcaacctcctgggtttaagccatctgccaacctcagcctcttaagtacctggactataggcacacactaccatgcctgactaattctattttttttatttttgtagagacacagtcttgttatgttgcccaggctagtctcaaactcctgggctcaagcaatcctcctgcctcagcctaccaaagtgctgggattacagtcatgagccactgtgcctggctcacacacatatatctatatgttagtctactagtttcaatgtaaatgttagt

SEQ ID NO: 137 - DNA, 18520 bp, Homo sapiens
tttgtgatttttgtgtctctttaagttgtcatgccttacataaaaaaggccctttcttccttcataggtctttttcagctcaggaaagttttttctcctatttatttttaaaattatttttctttcaaatactctgttcttttcttcaggaacaactatttgtctatctatctatctatctatgtatctatcttcttgtctctttttcagagactccaaatatccacacagtggactctattctttattctccatatatcatctttttatgatttccaattttttaactaaaataacctctcaaatctattctctacaccgactaaactttgtacaacgacatcaattctatttgttactgcctcaaatatagatttttaatgcttttgtgataggcaaaataatgttcccccaatccaaaaatgttcaagtcctaattcccataacctacaaataagttaccttagattgcagaagggactttgcagacatgattcaatgaagaacctcaaaatggacagattgtcctgaattatctggatgtgtcttcaaaagtagataacccttccagatgtggtcaggagacatgacaacaaaataagtcagattgctgcaatgttgctggctttgacgttggaagaaggaggccataagccaaggaatgtgagcagcctccagaaactacaaaagacaaggaaaccaaccatctctcctagagcctccagaaaggaatgcagccctgtcccgaccttgatttcagcccaaagtgacctatatcagacttctgaaccacagaactgtcagatactaaatttgtgttattttaagtcactaaatgtggggtaatgtgttataagaggaacaaaactgatacggctctcatattttcagtttctcatcattttgttttctcttactatcttctctctgacacttcatcactgtctgttatttttacatgaagttctcctatccatagaagccatgtattcttgaatgtgttggacggcaaataactccccgaaatgttcttccttccttagcttaaaattatttttagagattcataggtatgcctctgagttttctactgataacctctgccttgattttgtaggatgtcttgtttcacttgatttattttcaaatgttaatttatccagaatattttagcactgaaaaaactgtatagataatttctacataagccagtgttttccatttatcgataaaggggacggtgttgaggggaggcagaaaatgaactccctaggaatgcagacaaagcagaatcggaaactgggaggttctttttaaaactgtaccttcccatcctgaaaaaaaaaatctgatatacctcctctgcccagagagattcagtactatatactgagtcactgtgaatgacggcaacgtattataatgctcaagcatgttgttcaaaaaaaagaaaaatcttcaaccttttccacatagataattaacttgactggaaagttattaatacccaacaaaggatatttctacctacagagctaagtctaaaactttcaatacagtgcaccttccacctgctataggtaataaactataatccacaattaggactttgccacaggtatccatatagttcattattccataccctgcaatatttgaatattttaacattcaaagtatgtaaaacaaatgttatttggattaacctatctttcttttgtcattgtcaaacttttaaattgttcaatacaattggtctgttatttttgcaactacgtcactaaataatactactacagaagaactaagctagtttatgctgttgtcattctccacttcagtggcttaaaagtcatgtgactgacaagagtctttcattaatggaactgtctttgccttttgagtcaaaaaaactgttaaaccactgaatatggagtatttacctttttattgtttaacatttcaaaattacgaattaagtaggaatcatttatttttcatggaaacatacacctatctcactctattgttgcaaagatgctgaacatttctaccatataaaaaaggtataaatatatataatggtatgaaaaattagctctaggcctacatgatccttatctgtttaataggaaatttgagaatatcaaatatgatcaaatatgtatcactattttccattagtattattttagtcactctggatgaataccaaaaaaccacaaaattctaagtaatattgtttaagacattaacactttgagtcaaatctactgatatcaaaaacacagatacatatgcacaaagattaaggagaaagctggctgagtttcgcgtttctacatagaagaatgtccactggagcagggactctcaaaagatgctttggcattggagtgagacaaagaaattctttattgagctgatagatctctacattacacaatatttatcatctctgaacttcaggatcccaaaagccagtagtacttcctttaaagaaattagaataattttaaaacaccctggcatatttcaaataccccagaggtgtcacccagaatggaaaaccattctggaaatggaaaaccagagcactagattaacagtcctggcctcagatcccacttcttcttcacagcttaccaaaaagagacgtatctgaccggttcacattactccaccggtagagctaacccattataaaccactaagcactggagattttccatcttttattagacctctgccctacaccatgaaaagcagtaattgtaagtaagcgtatctgttccgcaatctgaaatttttctctcagctgaactaaagtctaggttctgggaaagagagtaggagtaaaaggggataggaagtactagtactcatttttggtctcatttttgcataaagcactatccccactcgacttgttattgcaagttgaagttgatatggcaggcgccacatgtctgtttacaaacgcaagagaggaaggaaagagctattattgagcccctaaaaatctctaaatccattgtaatgctctctctaagccatttgtctttatccctgtttctctaccagaaatgaacagagttgaataaagaaagagtcaagtaccaaacagttcaaataaaattacaagtactaacgaaataacaggtgcatatatacatttatgcgttttacaaaagcaatagctctttacctcttcaagtttttccttatccaataacaactttttatatctactactgatatccacttttattgataaagctagatagggaatcagaccaaagaaaataatgaactctatttacagatttctatatgaatatagaaatcaggaaaagagccacagtgaaaacaaccacaattctttttagccacaaattaaaatgttataaaagattattcacttaagtttaaaaaaaaaaaaacagttctaagtatcaagtaatgatattccagtggcatgtactaaaaataatcagcttttctttgtccaaaacggacctcgatagatgagaaagtttatggatttaatgttcatctcaaaagtacaattttggccagacgcggtggctcacccctgtaatctcaacactttgggaggccgaggcgggcggatcacctgaggttgggagttcgagaccagcctgaccaacatgaagaaaccccgtctgtactaaaaatacaaaattagccaggtgtggtggtgcactcctgtaatcccagctactcgggaggctgaggcaggagaattgcttgaaccaggaaggcagaggttgtggtgagctgagatagcgccattgcactccagcctgggcaacaagagtgaaactccgtctcaaaaaaaaaaaaaaaatacagtttcacatttttctcaaaatatttgacaatgttctttttacttgtttaaataccagaatatgctttaagaggttatgatcaaagggcatttgggataaaacatagattacatggttttgtaagatagcaacaaataactgaacattagtagttcccgtttgttagtgctcaaaaaaacaaaaaagtacaatgggaaagggggccccaaaagggaactgcagatgactgaaggccttgaacaaaggtatgttatggtaagaggcactgtggaagaaaggcaaaagccccactctgctcccagctatgtagccttgggtaaaagttacttagtctctctgtaggatgaggcaagtgggagagaataatttccttatccctaaagaagttgaacaaaaacagggtccatttaggcttaaaattgtgcatttttctgaggagcaagtcaatagctttccttggtttctcaaagtggtaaatgacaccaaaaaggttagtcatcctcgcattaaaaggtaatgtttcccaatcttttcaggtatatatatatatctatatatatatatatatctagtgatattaaagaggaaaaggtgtcattcaagacattacaggttctacctaaccagaaccaacacagaatcaataatgaatagatgagttaatttcttccccatttctaaataaccctaagattaaaaaaaaaaaaaatcacaagggaaatttgaaaatacttaaagctgaatggcaatacttatacgtgtttataaatttggatcatatacacaaaaagattaaaagtgtaatcaataatgctttacatttgtgtggatcattactttaatgatactttcacaaccaattattcctccttttttaggaaggaagggcatatcctagagtctccaatttacagataacgaaacaattattgcccaaggacaaacatttcttaaccatgccagtttcctgacttgtaggccaatgctcctcccaatgttaacaagcagcacaagcttccttcctgggggtttgcactgtaaacctgccagaggaaaataaaagatttttacctcttttgttttttctctctggaatgtttgttgtgctgaatcattaggagacagagtatatgagcaaacaaaggcagatttaaaatggttatctgaggttaccatctcacaccatacttgttgatcattaagtatgagccgagtgaagcaaaaacagctctacaggtttagcacacctctccacagtagagaatgaaagggagattatacattggggctcctctagcaataaattgcttcaacttcttcaggaggcttattaagctcaaacaagcagcagagaactccaagtagaagaaacctaatctccaatccccttttcctagtcatccacgcggacaccaacatctgatggattcaggaatacaccaagctccaagaaaaatacccccgccccacaacctcaccaccaccgataaagccacctaatcctgtctgaatctcttctctgcaaatgttttggtatgcaaatactcgttcattaataagaggaagcaggaaaaagagtgaagaggagtaccatgggaaagggggccccaaaagggaacggcagaacccagagagctgcactgacaagtaagcgaccgcgagtaatcggtcagcacaaaggagccaatcccgagccgcgtggaagaccttgggaggtgggcgggactaacgtgtccagggcccagcggctggcgccagacacgctggcagggcgggaaccgcgcgttccttagcaaccgcaatggccacgcccaccgaacccagcaccctccatcccccatcccgcagccagcgccctactcaacgggaacgggtccttcagtgatcaccgtacctactgggtttcccggactccgggtttctcttgcagagcctccctccgcccagccccaccaagtgccgctcccagggacggaacgatcgtctcccaaacgctttagggctcgctaaagaggtgcgcccgctttcattcccggaccccgagcttcccgggcagggtctccccaatcccctcgcactcgccggacacacacctcagctctgccaaggcaagggccgacaaacttcgtgtcctgtgggaaatgttgctgtccacggttctgtcactcaggggcaggggcgggacaagccagccgcacacccctactcccaaagggtgaggcggaaaagaggcgaggctctgcccccaggggcgggaccaggcctcagcctgctctcggattggtcggcctttctcccgtctgtacgccggtccaggacgcaaaggcgctggccctgaggcctttccctcattttgatgccactccggagttctaatacctgtctcacgaggtgactgtagaaattaaaaataaagactgtgacttgtttagttaatataaaacggaaaaatatgttattttgattattgaaccctcccatctcacacacacacactccccaattcacaggatcatccctaaggagcgtccctaagtggaagggcgcactgtctgtgtaaacaatcaattaattgcccattcaaacagcaaaaaagaaaaaaaaatcgttttatattaacattaaccagagattaataaatttaggaaagattgcaaaaacgtgactgacaattaggatttaggagcctatgttcgggtactcaattttcacatctacaaaatgggaatgaaatattaagatgttacttattggaaaagtattcaaatattaaatgctttataaattatactcatgtaatccttacaaaacccactaagagtattatccacagcctatggacaatgaaacacaggctaggaaaggctagatttattcaaccattcaacaaatctaagtgcctgcagccatcattttttaatattgtggtgaactaaatctaaaattccttcaaaaaattatgcaacctccaatttaatttttctcttgctcacataaaagtcaccttcctctaggccagccccatcatatctttttccaaaagcccttgagaaagaaagtagcatacaaaaaaaaaaaaaaaaaaaaaactgagacaagtataaatagactaaccagaaggctttctgaaatctcacagaatattatggccaggaattgaatccaaaatgtaattttattttccgtcctcctaaatcattttctggtctccagttcctctcccagaaataaaggtagagttaaatgagattatattaatacacttaaccagattacttatgtgtgtggctttaaaatagtgaaactctttttccttccatattaaaccaaaacccagaagggtttatcttgtctgatagatacggttgtagtaagaaaaaagaaaaaaaaaaagagtacctctggacaagtgccttgagattcaattaaaatgttcatcgtactgtgatgcaattgttggaataaaagaaacccattccaattacaaataattttacactcttgacctgctgaatatccaaattcttctgaaagcttgctaaatgtgaataactctctataaaactttcttgatttgtatgactcagagtccccattttctttaatcttttaaaaatatttggtttggccaggtgtggtggttcatgcctgtaatcccagcactttgggaagctgaggtggacggattgcctgaggtcaggagttccagaccagcctggccaacatggtgaaaccccgtctctactaaaaatacaaaaattaggcaggcatggtggcaggcacctgtaatcccagctactcaggagcctgaggcaggagaattgcttgagcccgggaggcagaggttgcagtgagccgagattgcatcattgcactccagcctgggcaactgagtgggactccatctcaaaaaaaaaaaaaaaaaaaaattagttttagactaaaaagaaagagttatgattatatattaataaatatataaataaatgctgtaagatttaaataaaagtggtgaatgtacttgagtccattttcattacataaagatgtacagcaatgcatttgtacagcaaatgcattgaatattctcacatatgtaagatattatacaacaagaagtaaatagcttaatgtaaaattaaaacttccagatgtatgttatatgcttatttctttaccatataaagacatatattattgacttacatttctagcaaattgaaatataattggctgcatagtattctatggtgtatatgtgccacattttctttatccagtctattattgatgggcatttgggttggttccaagtctttgctattgtgaatagtgctgcaataaacatacgttggcatgtgtctttatagtagcatgatttataatcctttgggcatatacccagtaatggaattcctgggtcaaatggcgtttctggttctagatccttgaggaatcaccacactgtcttctacaatggttgaactaattgacactcccaccaacagtgtaaaagcattcctatttctccacatcctctccagcatctgttgtttcctgcctttttaatgatcaccattctaactagcatgagatggtatctcattgtggttttgatttgcatttctgtaatgaccagtgataatgagctttttttatatgcttattggacgcataaatgtattcttttgaaaagtgtctgttcatatccttcacccactttttgatgcggttgtttgtttttttcttgtaaatttgtttaagttccttgtagattctggatattagccctttgtcagatggatagattgcaaaaggtttctcccattctgtaggttgcctgtttactctaatgataatttcttcagctatacagaagctcttcagtttaattagatcccatttgtcaattttggcttttgttgcaactgcttttggaattttagttataagtctctgcccatgcttatgtcccgaatgatattgcctaggttttcttctagggattttatggttttaggtcttacgtttaagtctttcattcatcttgagttaatatttatataaggtataaggaaggggtccagtttcagtttcctgcatatagctagccagttttcccaacaccatttattaaatagggaatcctttccccattgcttgtttttgtcaggtttgtcaaagatcagatggttgtaggtgtgtggtgttatttgtgaggcctcagttctgttccactggtctatatatctgttttggtaccagtaccatgctgttttggttactgtagtatagattgaagtcaggtaacatgatgcccctctttgttctttttgcttaggattttcttggctatatgggctcttttttggttacatatttagaattatgtttctgtgtttccaagtatttgagagttgtctaatatcttacagttattgacttttaattccattgtagttagaaaatatatattgtaatatttcaaattttattgaaaattattgacacatatattataacccaacatatggtttatctttatgactgttctcagtgtatttggaaaaaaaatgtgtattctgaaattatggaatgcagtatgctctaaatgttgattatagtctatatcttatgacagttttttttttttgcttttaaaaacattttatttatttattttattttttcattttactttaagttctaggatacatgtgcagaatgtgcagatttgttacttaggtatacatatgccatagtgatccttaccaacatttttaagcatattctatcacttattgaaagaaaggtgttaaatctccaactatgcttgtgcatttgtttatattttctttttttaaaaaaaattaattttttttaaattttaggttccaggatacatttgcagaatatgtgggtttgttacacaggtaaacttgtgccatgctggtttgctgcacctatcaacccatcccttagatattaagcccagcatgcattagttatttatcctgatgctctccctctccaaatcctcccctagcaggtccctgtgtatgttgttcccctccctgtgtccatgtgttctcattgttcagctcccacttataagtgagaatattcagtgtttggttttctgttcttacattagtttgccgagggtaatggcttctggctccattcacgttcctgcaaaggacatgatctcattcctttttatggctgcatagtattccatggtgtatatgtaccacattttctttatccagtctatcattgatgggcatttgggttgattctatgtctttgctatggtgcatagtgctgcaatgaacatgcgcatgcatgtatctttataatagaatgatttgtattcctttgggtatataccaagcaatgggattgctgagtggaatggtggttctgcagttctgcttctaggtctttaaggaattgccacactgtcttccacaatggttgaactaatttacatttccaccaacagtgtaaaagtgttcctatttctccacagtctcaccagcatctgttgtttcttgactttttaataattgccattctgactggtgtgaaatggtatctcattataggttttgtttgcatttctctaatgatcagtgatgttgaactttttttcatatgtttcttggccacatagatgtcttcttttgagatgtccctgttcgtgtcttttgcccactttttaatggggttgtttttctcttgtaaatctgtttaagttccctgtagattgtagatattagacctttgtcagatggatagactgcaaaaattgtctcccattctgtaggttatcttttcactcatgatagtttcttttgctatgcagaagctctttagtttaattaggtctcatttttcaatttttgcttttgttgcaattgcttttgatcttttgtcatgaaatctttgcccatgtctatgtcctgaatggtactgcctagattttcttctagggtttttatagttttgggttttacatttaagtctttaatgcatcttgaattattttttgtataaggtataaggtcggggtctagtttcagttttctacatatggctagtcagtttttccagcgctgtttattaaatagggaatcctttccccattgcttgtttttttcctgtttgtcaaaaatcagatggttgtagatgtgtggtcttatttctgagttctctatctgttccattggtctatgtgtctgtttttgtaccaacaccgtgcttctttggttactgtagccttgtagtatagtttaaagttacacacacaagggaacaagacaaggatgccctctctcaccactcctgttcagcatggtattggaagatatggcctgggcaatcaggcaaaagaaaaaaataaagggtattcaaataggaagagagaagtcaaactgtctctgtttgcagatgacatgatcctgtagctagaaaaccccattgtctcagcccaaaagcttcttaagctgctaaacaacatcagaaaagtctcaggatacaacatcaatgtgcaaaaatcacaagcaattttatacaccaacaatagacaagcagaaagctaaatcatgaatgaacttccattcacaattgctacgaagagaataaaatacctagatatacagctaacaagggatgtgaaggacctcttcaaggagaactacaaaccactgctcaaggaaatcagagaggacacaaacaaatggaaaaacattctccatgctcatgaataggaaatatcaatatcctgaaaatggccatattgcccaaagtaatttacaaactcaatgctattcctattaaactaccatcgacagtcttcacagaattagagaaaactactgtaaagtttatatggaaccaaaaaagagctcatatagccaagacaatcctaaataaaaagaacagagctagaggcatcacggtatccaacttcaaactatattttctttagttgtgttaattctttcattatatattttgaaggtctgttactaggctcatacacatctagaattattatgatttcctgatgaatcaacacttttatcattatgcaatgttgacctttttatctctggttatacttggtggtgaagaatatttgcctgatattaataatcttagattagatgtattatgcctgttgtttctactagatccatttccttgcctttacatttaagctatctatgcctttatagctctatctcttgtatacaatatattgttgaatttgcattttttccagtctgacaatctttgatttgttataaaaatatttattcaatttccatgtaacatagttattaatatgaagggtataagtctatcatttttctttgtattttttatttttcatttttacctttctcctccatttatactttcctttttttatttgctttagtcaaaaatgtttagacttccagtttgtgcttctaatggttctttagctatattctttttgttattttatttgtggttattctagaggtaacaatctatattgttatgctgagaatcatcaatgttgcattcatttaatattatgttctaagagtagtgccctgtgctcctccttcacaccaccccccagttttctgcctagctccaactttctacttgctttggcattatgccatttggcatgtccccatccaggagggtaacaacactatctttcacacccgggccaagaacacaggaaagtgaagtagaagagtggataaggccaatcccactaagtagaaggctaagcagtgctgagcccttaacaaaagccacaacttccagctgatctttactgtgtttcaagacctgtcactcagggccagcttcacggtatgagaactgtacaggcccacaacacccatggtcagaaggttcccctgtttgtttaatgatctactattgctgtcctgaaatttttaataattttatctttgaacttattttttgtaagttcagtctaatgggataatgaagcgtgtgcatgagcagaagagatattcacagtaagttctctactatttcttgtgatctcacttgcacatagagttcatggtgcctcgtgagcacagaattctgatggacccatcataggtgagagttcggcgagactcaaagcaaatgtgaggtaagcctgttatcaaagtcatttgttttgtttccattgagtattggtagaatgtgtgcatatcaagaaatgaaataagaacaattttgagttggtattttttgcagtttctactggttcagtaacaacaatatacatatgcatatatgagctatgaaatatgaactatgtaatttcagtgattctggatatcagtaaatgttcttatatttttgtttagaactgcaattgcacaaaatgaaggtgaacagtagcaatcacacttatgatgaaaaattttaatttctctacttagagcagcgttaaatagcaagtataaaacaccacgataacttcagagagactttggaagaaagcaataaaacgttttctgtcttatgcctttgatggcacattttacttttttttaaatttttttaaacaacgggccacacactttcattttgtcctgggctaaacaaattatttagcttgcactgatatcatttcactattaaaagatatacaaaggttgactttggtgatccagcttctgcagagtcaagattagtaaggataaaatttttggtgcaaagtgggagtaaggaaaacattagtaaggataacatttttggtgcaaagtgggagaaggagaaggaatagctcgggaggatgctaccaaatttgagccgcacagtacattccggtctagtacattctcgtcccctatagtactctgttctttacagaaggaggagtttaaatgatcaccactgtatgtgagtctgggaccccttatctgaaactgcaccactttggtatatttacgttgtgaaatcactagctttgggtaactgcttcctccatatcctgctgctggctgcaaacctgccctgtgcagacaacccatttcttctgcctgatctgctcaatagctccacatcaagtgcttgaaggtcaagttacatttcaggctggtatccctgtgccatcaacagcagcaacctacatggttgtcaccttgtcaacagttagctggaggccacatcagagaagtggagctctttggccaggaaagcctgaaacaggtgcacttccctgacagcaaggacatacccagtaacaaacagcacttctacatctactagctgctggacatcctggactatgggctcagcttccagctgcagggccagaacttgtatatcatccaactacgacagcacaaagtcttccggagtgagccttgtaccttatccaacagctcccacctcaaaccaatccaacagaaaatgaagtccaagctcttcagtctgaatctttttcaatgagctcatctcattccaaaagggccaaaccaacacacaaccacgatttgtgacctccttttttagggaagggtatcttgactataagtcctgaaacaagaaattcattattctatagatggtgtatggagactgaagcttggttgttgctgaagttcttctcaggaggggttcttaattgactgatagtatctagacatacatctcaaagactgaaccataaggtagaaaagttgaaggagctccatcacatccagcaatctcatcaattgcagactgtaatccaggctttcctgagcccaaccttgatgctggccagtggccctgactcattcacccacttgacccataatactgaagctgaagaaagcaactagcccagtcttcctagagggctttgtaaatggatgtggaggttccatggaacccatgggcaccttaccagttttagccttatgtcttctgcagggccttgcctgggaccaagaattggattttaatcaaaagaagaaagaagacagaaataactagctatttttttccacagaagctgaggagagagctgaaagacagctttggtttcagggttccattctcctctgaatctacctctactgtcctatttctggcaggcctggctctcagggatgctcaccttctgctcatgttccaaggaactcccacaatcaaggatacctggttgcttaaggtgtattgcccccagggggcctgctctcatggcctccccagtttccacaggctggaggagccagggtttgattttggtcccagagatatgctggtctcatagaaaaagtttgaaagtattcacttttcttcattgtctagaagaatttgtgtgcattgccagtgttactttcttaatttttgtgtagaaatctccgaggaagccaccaaagcctagactttttgtgggagaatttttaatacaaatacaatttttaaagtagatgtgggactattcaaactctctacttctttagtgaccattagtagtttgtatactgcaaagaatttgaacacattatatacactggcaaatttattgagataaacttgttcataatattgcttatattcatttttatttctgtagaattgtggtgacctcacttctcatatttctggtagtggcagtttgtcttatttttctgatctccttggctagagctttaattttattacctttcttaaagaagcagcttttatttttatttttttctattgcttttcagattcttattttattgatttccatttttatctttatttcatttttctgctaactttggatttaatttgctcttcttgttttagttactttagatagagattgaagccattgattagagtattttctgtcttttctaatataggagataaataatataaattcccctccaatccatacttaagcttcatcccatgaatttgaacatttttaaattttcatttatttaaaaaaacttctcatttcattttgatttctgatatgactaatgggttacttagaatatgttatttactttccaaatatttggagattatccagataatttcctgttagtaatttactatttaattctgttgcggttagagaatatactttctatgattttcattacttaagatgtatagaaacttattttattatataggttttcttggtaaatatcccatgtacacttgaaaagaatgcacattctgctttacttcaatagcattctataaatttcagttatgtctagttggttaatagagttgttcagattttgtatatctctactgattatgtctacttgttttaataattacttgagaaaggtgtttaactctcctactataattatgaatttgtgcatttcttcttgaagttttatcagttttcatgtattttaaagctttgtcattatgtgcatatgttatatcctctaagattaactgactccttcatcattatgaaatgacatttttcatccctggtaatgttctttgctctgaaatctactttgtgtgatattaatataatcatgtcagctttcttttggtcagtgttaacatggttttattttccagtcttttaaccaatttgtgtctttatattttcaagtgttctcttttttgtagacaacatgtagttgagtcttgttttttaaaatctaatttgactacatctgccttgtaattgaggtgttagaccatttatgttactgtgattgctgatataattgggtttaaatgcaccatcttgctgtttattttctatacgttcaatcccttctttgttctcttttcttttgctttctattttggaattatagaatacttttatgattctatttaatttcctttgctgacttcatagctgtaactttttaatggtttttttgtggcttataatatagctgtttaacttaccaccatctacctttaagaaatattatattatttcacatatagttaaagaagcttgatgcagtatatttccatttctacagtctttgtgctattgtcatgtattttatctctctatatatattaaacccaacaatacatgtgattatttttgctgtaacaattcaatattcttttaaagagatttttaaaatgtgaaaaaatgtatatttacccacatatttaccatttccagtgctctttgttcctttgtgtggatccatgttgccatctggtattattttctctttacttaaaagactttcttgagcattttgtatgaagtgtgctttctggtgatgaagtctttcaccttttgtatgtctaaataagtctttatgtttcatttatttttgaatgatatttttgctgggtatataattctaagtcaacagttttcatttcagtactttaatgacgttcactactttaaagggacttcaaatacatatgcattaggctacttggtatgttcatacttttctctttttttctctctgtatataatttcaaatcgatttttttgcttcatagctatatattcaagttcgctcatattttccaatattaattccatctagtacatttttaatcagacatttttccctatatttggaagtttaaattggtactttttaataccatctgtatctttccttaacatacttatccttttctctaccctcctgatcattgggaagatagttataactgcttatcatccttttctactaactatattatctaaattacttcttactctattactattgattgaaatttgttttcattatgtggagcatattttcttatttgttttcacacctgggcatttttttattgaatgctagacatttttaattttaccttgttgggttctggatatttttgtgtgttcatacaaatattcttgagctttcttttgaagtacaattgtcatgtagaaacagtgtaatccttttgagatttaagttttgttaggcagaaacagagaagcatttagtctctgaattttgtcttactattgacctagttatagccattgctcttggaactatgttgtatttccatttttgctggaataaatacaaactatttctgaccatgtgttggtcttatggatttttctctctgctttttccaggtgattcatttctcaaatgcagattatttcctcatattcattcatcaatcagtactcagttgaattttcaagaggaatgcattgtatctatccagagctcttactctgtagttgtctcctgtctgacacctttccctgtgaattgtagctgctttgactttgccagactcccaactacatcttcttaactcaggcacaccaccaggctctacctgggtctcctctccatgtgctgtggcctggaaactttggctctaatcacaggcattcatagcccttatgcatttgtttactccctctttgggatttttgtcccatgatacttgatgcccagtgcctgaaaaccattgtttaatagatgttgtccaaattttcagtgatttcagctgaagtttaaatccaatttctgttagttcatcatggctgggagcagaagttttgagccgctcaatttgtattcaaaaattatttatcgtaatttggggggtctaggaggatgtttcatttgtaaccagaggatttgtactgccactataag

SEQ ID NO: 138 - DNA, 2421 bp, Homo sapiens
acttcagtggcttaaaagtcatgtgactgacaagagtctttcattaatggaactgtctttgccttttgagtcaaaaaaactgttaaaccactgaatatggagtatttacctttttattgtttaacatttcaaaattacgaattaagtaggaatcatttatttttcatggaaacatacacctatctcactctattgttgcaaagatgctgaacatttctaccatataaaaaaggtataaatatatataatggtatgaaaaattagctctaggcctacatgatccttatctgtttaataggaaatttgagaatatcaaatatgatcaaatatgtatcactattttccattagtattattttagtcactctggatgaataccaaaaaaccacaaaattctaagtaatattgtttaagacattaacactttgagtcaaatctactgatatcaaaaacacagatacatatgcacaaagattaaggagaaagctggctgagtttcgcgtttctacatagaagaatgtccactggagcagggactctcaaaagatgctttggcattggagtgagacaaagaaattctttattgagctgatagatctctacattacacaatatttatcatctctgaacttcaggatcccaaaagccagtagtacttcctttaaagaaattagaataattttaaaacaccctggcatatttcaaataccccagaggtgtcacccagaatggaaaaccattctggaaatggaaaaccagagcactagattaacagtcctggcctcagatcccacttcttcttcacagcttaccaaaaagagacgtatctgaccggttcacattactccaccggtagagctaacccattataaaccactaagcactggagattttccatcttttattagacctctgccctacaccatgaaaagcagtaattgtaagtaagcgtatctgttccgcaatctgaaatttttctctcagctgaactaaagtctaggttctgggaaagagagtaggagtaaaaggggataggaagtactagtactcatttttggtctcatttttgcataaagcactatccccactcgacttgttattgcaagttgaagttgatatggcaggcgccacatgtctgtttacaaacgcaagagaggaaggaaagagctattattgagcccctaaaaatctctaaatccattgtaatgctctctctaagccatttgtctttatccctgtttctctaccagaaatgaacagagttgaataaagaaagagtcaagtaccaaacagttcaaataaaattacaagtactaacgaaataacaggtgcatatatacatttatgcgttttacaaaagcaatagctctttacctcttcaagtttttccttatccaataacaactttttatatctactactgatatccacttttattgataaagctagatagggaatcagaccaaagaaaataatgaactctatttacagatttctatatgaatatagaaatcaggaaaagagccacagtgaaaacaaccacaattctttttagccacaaattaaaatgttataaaagattattcacttaagtttaaaaaaaaaaaaacagttctaagtatcaagtaatgatattccagtggcatgtactaaaaataatcagcttttctttgtccaaaacggacctcgatagatgagaaagtttatggatttaatgttcatctcaaaagtacaattttggccagacgcggtggctcacccctgtaatctcaacactttgggaggccgaggcgggcggatcacctgaggttgggagttcgagaccagcctgaccaacatgaagaaaccccgtctgtactaaaaatacaaaattagccaggtgtggtggtgcactcctgtaatcccagctactcgggaggctgaggcaggagaattgcttgaaccaggaaggcagaggttgtggtgagctgagatagcgccattgcactccagcctgggcaacaagagtgaaactccgtctcaaaaaaaaaaaaaaaatacagtttcacatttttctcaaaatatttgacaatgttctttttacttgtttaaataccagaatatgctttaagaggttatgatcaaagggcatttgggataaaacatagattacatggttttgtaagatagcaacaaataactgaacattagtagttcccgtttgttagtgctcaaaaaaacaaaaaagtacaatgggaaagggggccccaaaagggaactgcagatgactgaaggccttgaacaaaggtatgttatggtaagaggcactgtggaagaaaggcaaaagccccactctgctcccagctatgtagccttgggtaaaagttacttagtctctctgtaggatgaggcaagtgggagagaataatttccttatcccta

SEQ ID NO: 139 - DNA, 5782 bp, Homo sapiens
gggtgaggactcatttactttcagaaaacaaatcatacagggtttatctgttacagtcaataacaagcaaataactcagaaccatcagcttagaacttagtcattcgtctagcacgtccttctgatcttgggggctgccggattcacgctgtcaaacaggacactgtttgcactgatggaaatcgctcatcagcagccgagttctttaatgcactgacgcaaacagcatctgcctctacatattctgattttatggtctccaattcttcacttaaaaaaggaaaggagctagaaggaggttctgaagtctgcatgacttaaaaggaaaggacgtgagtgtccttcacaaaggcgcagctgtctccacagccccgtgtcctcagccccaggcagagcagagacaggatgaccattcaggcgccctccatggtcactagggaggtcatgcggcctgggacaactatgtttagatttatttaaggttctatttacactggtcgcatattactgaatacactgtgtgggggtgggggcggagatatgccaggtgaaaggagtccctgcttgttcagtggcgtagccaccattgcagagcctgcagtggccaaactgggggaccaaatgtaaggggagagcgcagcgtttccagctgtgttgtctgcactcagcctcccctccccggtggggcgcctctttccctttgcatcccctctccctgggcagctgccctggctctgccccccaacccctggcaccagcccttgttgccagcccgagccttcttgctgagggtccctgccttcctgtggggttgaaggcgtggctggcctgggctctgctaaccttagagtgggctcctgccttggagcatggggctaacatgggtgagggtctcagccaggggtgtggacaggagggtggctgctgagagtgcacacttcagccagctctaccaacggtcctgccaccagtgccctgcacacgcacagtcactgataaggtgtctgccatcctttcctgcctgcatttctcctccatcaggcccctgcagggggtaaagggaaccccagcagggaaagaccctgtgctcagcccccactccaacagtgggtgtgggaccctcccccagagtcctcatccctggcacagcagcagctgcctgcgcaggccatggggacagagatggggacagcaagccccatgcacgcctaggccatcatgggcatcataggcatcgtgtgtctgggcacgctacatccggcaccttccaccacatttggaaaatacttctgcattcaccttcctaaccgtcctgcttcatttcccgtcatttgcaagagaaacacacaaagcaatgcacttaccctgcccggcagggcttcctatcccttggagatcccaccgtgtgttgtgcagggaggaaggacactgtcccttcatagcagtggtgggagaggaaggtctttaaacctgggaacagagtgcagtgaagaaaaaacatccacaagggtcattgcttggttaggatgctgtgctgggcagcttcagaaatgtcgctgagcgcgcatctgcctaaaccgtctgcaggagggagaggccgggcctgcttcaggccatgtcaccattgaaggcagtggcagggtctctgccctccctcaggacaacagcacgtctagtcatagtgctggtgccttctgacacccagtgatgctgggacagccagggctatggccactcttgacgctggcaaagtggggcctttgccattagccacccctcatagcctcgatgatgtggcctgtgggctccagtggctcagggtcatcccctccacctcttcatgagggtcagtgatgcccccacctgcctcagggcttggcccccactggggtcagccacagcccctgtgacgtcctgaacagctcaggacagaggccagggccgctgccacccaaagtctggggccaccctccaggcaaacgtgtgcgctgtccacggggctgccagcagcctggcacccgggctgtctgggaaacaccacccagcaggacagcagggactgggcaggaggcaggagaggggccccagggtgtcgtgggccacaccaggagccaggccgtgtcctgtgagtctcagggcgacttcactcctccgtgtctgatgctggggctggtgctgccctgtatgacatctggtgtggcagtgacggcctgcagggccgtcacacacaaccttacccccgacacacagaggcctcacatcctcatccgcagatggcaagcccacagccaagtgtgcaccgcccaggggtgggggaagctgccggcaagagcagtctggctcctaggacatctgtgtgcctgaaagtcagctcccgactgtccctaggacagccccgtctgtgggtcttgcacctggcatgggccaggtgcctggaatgcactcagcgggcgggcccttccaggtggctgcagctccgcctccctgcagagtggctctggcctctctccctgctcctcccatgggggtcccacaaggacgtcgtgtccacggccctgggaggaggccgacccactggtcagcaaccttccaagccggctcctctctcaagtgcagggggcaggggggcagctgcctcatcacccagacgcagcctccagggtggcgcctcaccgacatctgatgtcccggtttctgtctgcccctagatgggccccagatgtcctaccggcacctaaaactccacgtgtctcaacagagtgtgtcatttccacacgctcattctccttccatgccctctgtgctgctccagaacaaccgggtgctttctgcctcacagccacagaacccaaacccgctttcctgagagcatctcaggccctgtggccaggatggggatccagagacccggaaggcgtctcctgcctcggggctctcatcctggtgggagggacagagctgcagccactgcctgtggtgatgggctgagggcaaaggggggggccaggcatgcaggggggctgcccaccaccccaccccagcaggcagggacagggagggggcatcccaggggcattctaggcagagccacactgggctcaacaaagggcagtcgggagaatggcacaacccaaaccgcttcctaaaattctcgcggcttctctaattttctcggtattccctttcttaataagccttagataaatacctcactttgccatttcttaggttttaattttcaagccacactagtttttaatttcattaaatcttttcaagcttcgtaaagtttgccaaatcactatttctttctctcataagggttaagattttagtatcaggaattactcgatttaatttgatacagatttatctgaaagcgaactgtaaagaggcgggaaagtcgaccgggcagcgagaatggcacacctcatggtctacatattttcttctttctttcttttcttttttttttgagacagggtctggctgtcgctccagctgcagtgcagtggcctgatctctgctcactgcagcctccaccttctgtgctcaagggctcctcctgcctcagcatcccgagtaactggggtgcccggctaattttgtttttaatttctgtggagatggggtctccctatgtcgcccaggctgaaattctacttttctttttttttgagacagaggtctcgctctgttgcccaggctgaagtgcagtggcacgatctcagctcactgcagcctctgcctcccgggttcaagcaattctcctgcctcagccccccgaggagctgtgactataggtgtgcaccaccatgcctgacttattttgtatttttagtagagacagggtttcaccatgttggcgaggctggtcttgaactcctgacctcaggtgatccacctgccttgacctcccaaagtgctgggattacaggcgtgagccactgcccctggccaattctatgtatttttaaagttctccttttccagcgtttaaaagctggtgacgtcgcacccactgcctgatgtgtgcagactgcaactcttgtgtctgaactggcaccagccttcatttctggttcattctaaactctgtggtcgggtaacaggtcaccgccgcctggcccgaggccccagcagcagccccgggagcctggaggacctgcatgttccgaagcccacccagacctgccgtgttggatgctctggggggtccccgcagcctgggttctaccaagccctccagaggatgcaggtgcccaccacagtctgaggaccactgggctcaagaaagagtgaggcaggatgcgggcaacctctttgtgcctgttttctccgctataaagtggggcaggagcacctgctggggtgagaagagcactgtggagaatgaaagcttttgggcttcagggagtgcggcgtggcattcgctcccactcctcctcctctgtgcccactgcggccgagccgcaggaaggcaggatcttgcctgttttgttcatggacacgtccctgcctcaaaaaccaggcccggcatagagcaggggctcaacaaatacgtgctgagtgtatctcacttgtatggctagctacggtgtaaccccaacaaaaccacgcaaccttgttgaatgaagtaaaggatacctgtgcctgaagttacagaagagcttccacacagatatcccaggctgaatttctgcacaaagttcttgccactttgactaataagctcagagtgattataaaactattgttttacaggccaggcatggttgctcatggttgtaatcccagcactttgggaggccgaggtgggcagattgcttgagctcaggagtttgagaccagcctgggcaacagggcaaaaccctttgtctacaaaaatatacaaaaaaaaaaaaaattagctggtcacggtggcatgtgcctgtagtcccagctactcgggaggctgaggtgggagaatcacttgagcctgggaggtcaaggctgcagtgaaccgtgatcgtgctactgcactccagcctgagtgacggaggaagactgtgtctcaaaaaaatttttaaaaaatatattttaaaaactattttttttccaattaatacttccacttgaacagtttggggtggcctctgtcacctgcctaccagatgtgagaggctggtggcctggcgtcttggggttccagcacctggggttctggagtgaactgcgtccgtcatggtgtctactctgtggcttatgcttgggtccagggggcaggatctggtttagagcaatccaggttccagtccagaccctgccacgttctggccccggcacatttcatgaggcccttagcttcccgtctgtgagcaggtgggggcccacctctgacggtgctcagtggattcagtcaggtaacatctgtgaaggcagtcggggcacgaccagcggggagcgagtctgcattattctgagttacctgaaaagtcgtatctggcaagacccaaccaccgtttcttctcactgtccttgatgatgtccccgtagaagccgtagcccagcagggacacggagtagcgaaggagtgtgctgttgtggtggactgaggacacatccatggccagcgagtcccctgtgggagagaacggccgtgagggaaggcagcccccctccagccccgccccatccactccatccccttcaatagcactttgcaaacgtgggagttacttttaaaaagtgtgaaacaaacagaacgcattcagtgcaaggattctctctcttggggtgttgg

SEQ ID NO: 140 - DNA, 26 bp, Homo sapiens
agtaatagttttacttattaacttac

SEQ ID NO: 141 - DNA, 340682 bp, Homo sapiens
actgtttttttgggcaattaatgcctcattgtaaatgaaaaaaaaatttttttttctttaatttgtttcattagttgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttcctttttcctaggtaggtgtaaactcaactctgcaatctctgtattttttcctaacatctctatagttgttaacaacgaggtaacattctctctggtggctgaaatgcaatttacttaaccattttcctattataagacatttagatgatttctatgaacattttttttaaaaatcagatttttttgtctttttaagaaaaagaggacctagttcacttatttctgaataagtttcttttgtgtggaacagatggaaatgttgggaaaaaaaagaaatctacacttttctgttgtcctaatgaggcagtgaacttagttggatagcctgggtagttcatactacctattgatatatacccccaaacagaaatcttcctttttttttttttttttgagatggagtcttgctctgttgcccaggctggagtgcagtggcgcgatctcggctcactgcaacctctgcctcctgggttcaagtgattctcctgcctcagcctcccaagtagctgggactacaggagcccgccaccacgcctgactaatttttgtatttttagtagagacagggtttcaccatattggccgggctggtctcgaactcctgaccttgtgatctgcccacctcggcctcccaaagttctgggattacaggcgtgagccatcgcgcccggcccaaactgaaaaattttaagtaacagatgtattccagaccttgttgaataccaacacagcagacagtttgctattataacttctagcaatagaatgaagagatgccaaaaataaggattacctaagggagactactgactagaattagaagaagatgggaggcttaacattgggaaacaacagtgtttaaaggacaaacagaataaggactaggagctggggcatgtcagtgagagggtaggaaggagccaggaggccagggcgggctacccatcccctccatgcaccactagtgattaccatgtcactaatccaacatatgcttcacagtcctagctttcagaatgctctccttgaaatttctcgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattaatgctctgatgaatgactcattagcattgtaagaaatgggttgcaggcgggacaagcacctgttgggagggaaaggaatgtgtaatgtaaaacagtagtagtggtggggcatgggcacatttaagcagcagaggggtaggtgggggctggtggcaaggagtgggaagggagaggcaagatgacttcagatgttagtttacttgattagcagcatagcgtcaacaaatgagttgggcgctatgaaaggaaaagcaggtttggacattgctgagtttggggagccaatggaatatccaggtgggaatttccattaggcagttgtaggtaaaaggttcaaaagctgaggaaagggtctggaatctaaatctgtaagtaatcacttggaatttatacatccttggttttctttcctattatctctacattatttcactattgttaatatatgtttatacctctgacactgtatgctgattagatcctgccttagagatagctcccttcccctctttctctttacagctcacacgttttgctctacctacaattgtttctacctgttggtatgtttagttctacctgattctactctatccgtcttagatatacagctctctctttccaattggaaaatgttccctacctccaaagtctttcacttttaacttatgtggaagataattatagtgctatttagggaaaaataatcaagtgtgttaagaatgccttatattcagatatatttatagtagaagggaccagtgcatactgaatattattactctcctaggcactacggctttggaaccactactttgccttctggtcctaaaaaaaattatttttaatgtatcagaaatatacatgataacattttccttatgtaaataaaaactattaagccttttttatatagagcagtggacttccatactgctatcatttgaatataaagaagcaattttgttaatttacctagatttagattttagatttgctgttttcttatttcgtgcctttaggcaggttatttaacctatttgatctctacttgcttggtatatgggaggcatgcatagtattttgttgtgactagtaggttaaccacattgtgaaggaatttatggcatgatcagaacgttttttctctctctagatgttgttattcatgaggaccaatggattggcgagacagtactacaatcaacatttagcagtcagttattaaatcttgggagttattcatctattcagcctgaagaatgtaaggcacattttaaatgaagtaatgtagtagtgtttaaagtataaaaacatactaggaaagattagggttaaaatggttcttttacaaaatgttttctaaacagttggagagtattggtttcttttcattagtaagaatgaaaatagaattttaagaaatgaacttgtacattgtaaatcacatttattttaagaagtattgggtctcatgtttcgttttcttaggccatcagtatagtggtggttcttcaccttttagggagtcagagacctctttgagaatctatagaccatttctccagaaaactggacttatgtagataggcacaaaattttgcttataattctaaagcattccacggacctctgaagttcttctgtggaacttctgagcctctgattaagaatccttgaggtaataaaaatgtattggtctcgtattcagacagctgtggtttgaatccttattctcctgtctaccactgctaagaaaagctatctttcttctttaatgtccagttttctcttctttaaaagaagctgtttaatgaggaaactagcagctatctcctcctctaggaaataaaataacataaaaaaaagaaagaaaacaaagtaagggaaacagtataaacttgtggttatggtcactggactcagatagaccaggatttgaatactggccctcttacttccagtctttgtctttaggcaatgtatttcacttcactatacttttgtctccttttctgtgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaaatatcatacaagaaaatagctagagaaatatactgattatacaagaagataactggaataataggaaagttataggatatatatatggaagatagagcatggaattccaatctttgaattcttaaagaaaggcagagcaagtagaagggaagagcaacaattagaataacaagaactgtgtttggaatgggcaaggtttcattatatactagggtggcccatcagcagaaaaccaactctgacatatttcatagacaactaaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatgtgcaggtgataatgagtgctatgaaggaaactaacaaagggttaagatacagaatgccgtggttctagttgagaaggattgatcatggagtagaatcagggttaggaagttgttacaatagctgcagttgagagataatgggaggccagtggagctaaagagctgagatatatttgtaaatagagttaataggattttctgatgatgtgggtctggggatcagggaagagggacaatctactgctactgaattactggtttaagtaactaggtagcctttattgggaaagactgagagggaactggtttgtggggaaaaggactatgtttcaaggcatgttaagttttagatatctttgagatattcaagtggaaatgtcatataagaactggaaacaaagttcaggactcagaagacaggtttaaaattaagaggcaaattttagagttattagcatacagataatatttcaaatttaaaagttttttaaataataaatatctgtataattatagaatcacaggggattgcaaaaataatacataaagtcccatgaactcttcttctagcttctcccaatggtgatatcttatataactttagtacaatatcaacaacaggaaatcaacgtttgtataatactgttaactagtaatatactaggatactttccctttcagtatcaataaatatagtatcagcctggcacagtggcttatgcctgtaatcccagcactttgggtggctgaggcaggaggattacttgggcccaggagctcgacaccagcctggatgatatggtgaaacctcatctctactaaaaatacggaaaaattagccaggtgtagtggtgcacacctgtagttacagctactagggaggcttaagtgggaaagaaagttgaggctgcagtgagccatgattgtaccacagcacttcagcctgggtgaccggagtcagaccttgtctcaaaaaaattttttttcttaaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaatgcacttagacaagaagaggcatctggtctggtgcggtggctcacgcctgtaatcccagcactttgggaggccaaggtgggcggatcacttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctgggaggtggaggttgcagtgagcaccactacactgcactgcagcctgagcgacagagtgagattcggtctccaaaaaaaaaaaaagaaagaagaggcatttgaatggataaagaagaatgaaaattatttctatttacaaatgctctgataacatacctgaaaactccagggaatcaaagttaaaacaaatttaaataataagataattcagtgatataacagaatgcaaaattagtgttaaaaaatatcattaggctgagtgcagtggtttgcgtctgtaattctagccctttgggagatgaaagtgggtggacagcttgagcccaggaattcaagaccagcctgggctacaaaaaagaaaaagaaaaagaaaaaaaagctgggtgtggtggcacccacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaataataatagtaattagacttaatatacacaaataataaacagagggcataatgatagtgaaaaactcatttactatagtaataaagaagatagttcaaaatacagttaacaagaaatatgcaaagcctatatgaggaaaaaatttaaacactccagaaagaaatgaagacatgaagaaatggaaagacattccctgttcttggataggatgactcaacattataatgatgtcagttcttcctaagttaatatgtaaattcaatgtagttccaatgaaaatatatatgttatggcatataaaagttgatactaaagctcataggggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaacagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacatatctcacaacaaacagtaataaacaccatatggattaatagtctaaatgtaaaaaataaaatcatgcaacaacaagaaagaaacctgaatgaatcctctgtaatcttggtgtagggaaaggctttttcttaatattactcagaatccaggggcagtagaagataaactgatacattttactatagaaaaataaattttgcataaccaaaacactataaacaaagtcaaaagacaactgacaaacttggagaaaatatttgtaacatacaacaaaaggctaatatccctaatatataaagaacttttaaaccctgagtgacaaaggctgggtgtggttgttcacactggtaatcatagcattttggaaagctgaggtgggagaatcacttgagctcaggagtttgagtccagcctgggcaacatagtgagaccctgtctctacaaaaagtcaaaaaatcagcccggtgtggtggtgcatgcctatggtcccagctacgttggaggctgaggcaggaggattgtttgagcccaggaggtcgaggctgcagtgagctgtattcatgccactgcactctagcctggcaaaagggaaaatgtgaaaaagagatgaacagtcagttttcaaaaaaagatataaaaatggctatcaaatataacttattagagaaattcaaattaaaactacatggagataccatttctcacctatcagattggcaaaattaaaaaaaagcacattctgttggcgcaactgtgaggtaatgtgccctcttaatacattggtggtaggaatgcaaattgctacaacccttgtgaagggatatttggcaatatctaacaaaattacatatgtacttagctttcaacctagcaatcccacttctaggaatctaccctgaagctacacctccaacaatatgaaaatacatatcacaaggttattcattgcagtattgtttataattgcaaaatatataggagaatgattcactaagttatgctacattcacatagtggaacactatgtactatgcagctgtacaaaaagaatgaaaaagatctctatgaactgatatggagtgattcccaggacatactgttatgtgaaaacataaaccccccaaaactgtatgtagtatgctgtccttcctgtacgaaggaatggaggtataagaaaatacctcggtttatttgtggaaagaaaatgcaggaaggataaaccagaaactaaagagattggtcacctacagggggcacataggagaggggtggaagaaagtggggaatgggaacaggatagcaggggtcaggaggaagtgacactaacaaatgaatgtaatattgttacaagtgaacctaatattgttacaaatgaataaaataactacacagaagcgggtggggaagaaaagaacaaacctaagtagctgtggaaaagagtatattgactggattctataaggctaatgacagaaaggactgtacataaatgctgcaatctagttagaaatatgtttctcaaaggggaatggcttagcaataaccttatgtacatactagaatgaacaaatgagtacatagattgtagataaggaaagctggatttctcactgttggagaaagaaattataaacaagggaaggttaaaacgaaccagaggtattgttataaactgaggatttttaatatagataaatggatacagaaatataggcatgtgtatatgggtgggatagtacacatacataaacatctcctagttctgtccattgagcgagcacagcacagatgcagttactccccagtaataatgagcatacctggtgcccagatcttcatctgtaaacattttcttttcttttcttttcttttcttttttttttttttgagatggactcttgttctgtcacccaggctggagtgcagtggcgtgatcttagctcactgcaacctctgcctcctgggttcgagcaattctcctgcttcagcctcccaagtagctgggactacaggtacgtgccaccacgcccagataatttttgtatttttagtagagatggggtttcaccatgttggccaggctggtcttgaactcctaacctcaggtgatctgcccactttggcctcccaaagtgctgagattgcaggtgtgagccactgtgcctggcctctctttttttttgagacagggtctggctctgttgcccagtctagagtacagtggtgtgatctcggcttactccaacttctgcctcctgggctcaagccagcctcccacttcagccttccaagtagccggtaccatagctgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaacagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttactgacataaagatatatgtatttcattaactaaccagaggggaagagagagctcttccttccaatggaattccaattaataaatctgagagaaaagaaaaaaaaatagagaattactggccatgctcagtggttcatgcctataatcccagcactttgggaggctgaggcaggtggatggcttgagcccaggagttcgagaccagcctgggcaacatggcaaaaccccgtctctacaaaaaatagaaaaattaaccaggtttggaggtgtgtccctatagtcccagctattcgggaggctgaggtgggaggatagattgatcccaggaggttgaggctgcagtgagctgtgatcatgccactgcacttcagcccgggcaacagagtgagactctgtctcaaggaaaaaaaaaaaaatacaaaacacaaaaatagagaattaccatcaggcagagatcacaataataaatactgcactgacacaaatgcactgatagatgctaaaattagtaggtgaaagtttgaggagagagagcattgcatagtctcaaagtatctccccaagataccagcatactagagggaaaataataaatttataagaaaactcttcagacaccaagttaactgagtgattgggataaatatcaccagtaataagatgtatggtatcataaatgctttgatattatccattgagaaggatccaccatattttttgtggaattgccaaaaatgcataacttcattccaatcataaaacactggagaaacccaaagggaaggacgttctactaaataattgatcaggattcttcataagtgtcaaggtaatgaaaaagaaaagactgagaaactcttatagactagaggagaccaaagagaaataacaactaaatatgaggtgggatcttggatgaaatcctacatagaaaaaggatattaataggagaattgataaaatttaaataacatctacattttatttaacaatatttaattaacattagtttcctgtttaagataatttataatatgtgagatgcccacattagtcgacatagtgaggaatataaggtaactctgtactatttttgcaacttttttgtaagtcttacgttagttcaaaacagagtttttaaaaaagctgtatacgatcatctcaataggtacaaagaaagcttttgataaaattcaacacttgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccgtattagagttattaaccagtgcaataaacatggaaaaatagatatgtaaagattggaaaggtagaaataaaactgccattattatagatggtttacataccttttccctctgaaaactacaaacaaattattagaaataatgtgaaaatttagcaaaggagctggatataagattaacatacaaaagtcaatcacatttctagagtgactaacaataacaaaggaagctgccattgacaataatattattttgtactaatagtaataaatgtaacaaagtatgtgcaagacctaaaaaaggaaaaatttttaaatgaagaaaaactaacaaagaatgaaataaacatatactttattcattgattggaagatttaacattgtgaagatttcagttcttttcaagttgatttgtaaattcagtgcatgttcaataaaaatcctcgtaagatttcaagggctcagtggctcatgcctgtaatgccagcactttgggaggccaaggtaggaggatctcttgaggcaaagagttcaagaccaataagattttcatgtaatttgataagattatatgatatttatgtagaagagtaagtggttgaaaacagcagggcattttaagaagaaaagcagggaagaataatttgccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtgtgtgtgtgtgtgtgtgtgtgtataaatgatagctaaatggcttctaagtaaaattcagcatatcttgtatatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaattatgtgaaaaatcttgaactaattagataatctttagaagttacttcacaatctttgtttttacacatacacaggaatttatggtgctttattttttacaggttagtagctaaataaagtatattctaaagttttttattgatgtagggaaatggctaccagtggacattttgagaatattgcagttgtttttcttctgaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactctgttacccaggctggagtgcagtggcctgatcatggctcactgcagcctcagtctcccaggctcaagagattcttctacctcagcctcctgagtagctgggactacaggtgcatgcccccatgcccagctaatttttgtattttttgtagagaccaggttttgtcatgttgcccaagctggccttgaattcctgagctccagtgatcctcttgtcttagcctcccaaagtgctggaattacatgtgtgagccaccactcccagccccagaacaactattattaaaaagtcaaaaaacgacagatgttggtaggctgtgtagaaaaggaaatgctcatacactgttggtgcgaatgtaaattagttcagccgctgttgaaaacagtttggggttttctcaaagaagttaaaactgaactatgatttgacccagcaatcccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacgcagccataaaaaggaatgaaatcaggatggtgcagtggctcatgcctgtaattcccacactttgacaggctgaggcaggcagattgcttgagtccaggagtttgagaccagcctgagcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaatagagtgacaccttgtctcaaaaaaaataaataaataaataaataaattgcagcaacacagatgcagttggaggcaattatcctaagtgaattgagggaggaacaggaaaccaaataacatgtattctcacttataagtgggagctaaacactggctactcatggacatagaggtggcaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgttctttcatctttatagtgaggtgttacatgttttacaaacctagttctgataatgtgacaggaatataaatttatcttgaatattattaaatatataagtcaaagatcaacacaatgtttccatgaggtagactttttttggaatctaaataaccatgtgtttccatgtaaatttttatgaatcagggacaaatatataatttgatgttagagatgtttttgttccccaaaagctctatcttgttcatgaaaaacgaagcccagagaagttatgtacaagttcacagagcttattattgacaaaaccagaatttgaatacaactcttctgattccagatttgctggaaatactgtgaaagaagaactcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaaacacaaatcagtttatggagtctgctttctaaaaagtacttaagtgtttattgccaatatcttattttggtcagcaatcaatcacgtactcaagcatacttgtcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaggacatagtaactgaagaattaaataaccaatccaacacttgaaaaatattacaatgtagcacgtgctcaaaagctctctgagctcagggaacaaagcagcactgtgaatctatagtggtaatcattctatgtggtattgggtaggacaagacagccttgcagctggaaattggtgaggacggaggcctcgctgtggaaagagtaaggcacactcagggagagaaccagtgaggtggctctgagcctgtttcagaaggggcttgaggaagaacggcagaggataggatagttgggaaagcaggatcaaatcagactccagggactggggaaccaattggctgttacagggtggtggagtcaaaaaagaacagaaattttctgtttggttaattgatagaaaatgatattattaacaaagtaaagaagtatgggaacagcacaagttttttggggatagtaaataattccatttccattgattaaaaatatcaagtttgtttttacatctaaactgattcaagacttagctattgtacatgttttagagaaagcaaaactatattttatatctaatcatactttacaacataaaatacagttctaaaaaatattatttgtgaagaaaaatataatgttgccatcttttgtctgtctgtatgttttttttcccttagattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacaggtaaatattttgactgcctccttaattttagattatgaaaaaattaagatacaagaccatcttagtgtaccatttggttatcactatatatgtatcatcagctattaaagtatggtatcacgtgtgatagagtaatgccaactaaggtactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaagtcttaaatttattcccaggtatactactttacccttttagtgaagatcttacctccttcaaataatgttctttaaacatttaattctggagaagcttctacaattttttttcagccagagtactctgataaatgctatggttataaggcagatgtcaagggagttaccttaactctttcaagtcacaattaatgttcaataaattactgtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctattgtgagatcctttagttgtaacaaagacagtttcatttgtggcttatgagttatttttccctgctaaattaatttagagattgattcagtatattattattttttacctgaaagagttaatgtctctccaaacttctgccttccaaatagttatttgtagataggagctatcacattgtctctcttaatcattaatagctatgactaggatttgagataagtctaactttggacttttatgttaagatcaaacagggacagatgtttgtttggttgagcaagctgacaaacatgtatcagtgatagactaactatgatcattgaccaccatagcctggctgagaacatgagtctagtgcatgctacacaagaatgtaggtcacaggtatagtggagccgtaacaaagcagattgctccatgtttaatgtgaatattcttttaaaattaatagttttttggttaatagaagagaaattacagttgtctctaggtgattctatggtgtttaggttagtattgaaaacatatgaatccaggaattaagatgttgttgttctttgtacattcattcatccagccccccttatttataaccatcattttaaagttttaacatctacttcaatacctcacatcagtctttttaagataaaaatcccaattttgaaggattacttaagtaattctattttcctgattttacttttcttttcaagagaccaaccccatttccaaattcccagcaaagagaatctgattgcccagagtaaatttgattcaaaaaactgtgatcaggaagacaaggtcacacaatacaaatatgagagcttgagcttatttcagtggatgggaaaacagttaagggagtcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagttcaagttctcatcttaaaaaaaataaaaaataaaaaaaaattggattgtaaaacttcacgtatagaaaatatgttatcatataataaatatttttatgtttatataagttaatacataaaaattttcaagaaaaccctttatatataatagtatctcattttaataaaaatgtatctataagtacatatgtgcatttgaaaacctggaaatatgcatgtatagcaaaatgctagcagtggttatttctgtatggtagtattatatgtgctttaattttttctttatacctttagtttgaatttcatatgtgtgtgagcatctgcatttacttttaaaaacttctattataaaagccttcaagcatatataaaagcagagagaatactaagcataaggcactttttttttttttttttgagacagagtttcattcttgtcacccaggctggaatgtagtggcatgatctctgctcactgcaacctcctcaagttattctcctgcctcagcctcccaagtaagtggaattacaggcatgtgccgtcatgcccagcttatttttgtatttttagtagagacgaggtttcaccatgttggccaggctggtctcgaactcctgatctcaggtgattcacccgcctcagcctcccaaagtgctgggattataggcatgagccagccaccgcacccggccagcataatgaacttaggtacctattagccagcttattaaaacatggtcagtcttgtttcacctgttacctcccttgtctttactgtttaaatatttcacaataaatatattttattttataattaaaaataaaattaaaaccttatgctttttaaaataaaagaatagttaatgtttggaaaatctagctaacaatgtgagaaaaaatagaattaaatttatactttatgtttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaaccaaaaaaaaacagaaaaaaaattacattgtcagaaaataatgcagtaagcaaaagacacatatctatagagataaatggggaaaggatatgagtaggcaagtccccaaagaagaaataaaaatggccaataaatatatggaaaaattgttcttacaagtaattgaaaacacacaaagtaatgatgatagatgatttttcttttaagaaattgatagagaagatatgggaaaacagctactgtcatcagctattggaaatgcaaactggcagaacctttcttgaggataactgacaattaatatgaacaaattgggggtacttttagcccaataattttagctataggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgctctgtctttacagatttactgagatgtttgatgattttccaccaaaaaaaaaaaaaaaaaatctctagtgaaagaaactaaggagatgagcaggtgtagtaaattagatttatggcctgaagtgagaaactaaaaagacagctgatgttatcagaaaaattagtgctaagaaaccctcttttgttttattatagttttgaagttgaatttactaatacagaatatgataatacagataagttgaatttactaatagagaatataacagtaataaggtctgtgttattgtggctttaagtattagaattgtggccggcgtggtggctcccgcctgtaatcccagcactttgggaaaccgaggcgggcggatcatgaggtcaggagatcgagaccatcctggctaacacggtgaaaccccgtctctactaaaaatgcaaaaaaatttagccgggcgtggtggcgggcgcctgtagtcccagctactccggaggctgaggcaggagaatggctagaacctgggacgtggagcttgcagtgagccgagattgcgccactgcgctccagcctgggcaacagagcgagactccatctcaaaaaaaaaaaaaaaaaaaaattgttactgagagttaaaaataagtacaattgtgtctaaatgctttttgttctagaaaagttaactaaaataactattgaaatatgagtgaaatattagacttgggttcatttcagtgtcctttctttaacaaaacaaaacacaactttgcctatagatagatacatgagaattttctttacagaaagcagttggttattataaatgatgaccgttcaggagggcaaggaatctttagaaaatattttattaaaattatctctggtggcccggcacggaggcttatgcctgtaatcccagcactgtgggaggccgaggtgggcggatcatgaggtcaggagttcaagaccagcctgaccaacatggtgaaaccctgtctctactaaaaatacaaaaattagccgggagtggtggcacgcacctgtaatcccagctactcaggaggccgaggcaggagaatcacttgaacctgggaggtggaggtttcagtgagccgagatcacatcactgctctccagcctgggcaacagagtgagactctgtcttggaaaataataataataataataataatctctagcatgcttctgttgtcttaatgcatcattcatattttgtctctgtttacccaaattctttagtgataaaagattagattcaactgacttaatcagatcaatctatttaatctgatactaagcctagatttttttcctttttggtgacttttgtttttactgttttttttaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatctttatatacataaattctgctatttttatttcttttgaaacagggtcttgctctgttgctcaggctggaatacagtggtgtgaacacagctcactgcagtctccacctcccaggtttaagtgattctccccgttcagcctttcgcgtagctcaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataattctatataaaagtgaaatataaatctttgcaaatatctgaactagattccagtagttttaggaactatgtgccaggaaccagggacaaagagcaaatacctattttttattatatgacaagtgggagcagaaattcagttccttactttatcttggccaaatgccagattaaaatgttactagttgggttaattcacatatatgtataaatatgttttccaatatatgattgaaggttagcattgttatatcataaaactatgctaaggagaatacaggcagaaaacaaagacaatacctctcaaaaaacccaacttttaattgaatacagagatttcattctcaaagaagagctccttattcctagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctacattactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccatgctgatgatgaaagattctgaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctctttcattctctttatgttcagctatgagggctgaattcatagtttctgtcatagtgtatgtgtttttaagacaaaaatggggagagaatatgaaaacacaaggaacttttccctaacctattttatagttaaacaaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagccggagtgacccccttgaaagcaaagtccacattcagcatgaccttttaattcttttcaagagttgtgtaaatttacaaaatgataggattatgtgaacattcttttaaaattattgaattattaagaattttttaggctgggcagggtggctcatgcctataattccagcactttgggaggccgaggtgggtggatcatttgaggtcaggagtttgagaccagcctggccaacgtggtgaaaccctgcctctactaaaaatacaaaaatcagccaggcatgatgtcgggtgcctgtagtcccagctacttgggaggctgaggcaggaaaattgcttgaacgcaggaggcagaggttgcagtgagccgagattgcaccactgcactgcagactgggtaacagagcaatactctgtctcaaaaaaaaaaaaaaaaaaaaaaaaaaagactttttgagtggagggaggagagcaagggtttaaaaactaactgttgggtactctgcctactacaggagactctacttgggtgatgatatgcccatgtaacaaacctgcacatctaccctctgaatctgaaataaaaatcgaaatttttttttttacataattttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaaaaaaaaataataataattttgtagtgatttgacatgtctttggaaagatgtggtattgaatcttctacagtttgttacatattcgatcgctacacactcctgctaactcatgtagggatatgtgacacaattggaagagatgatgaaaccatctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaggaaaactcatagacctcaccagtacacagtaagacgaaagtaaattaggaaaaaataatgtctgggagatagtagatattcagtatttgtttactggtgaatggatgagccattagcagtgaattatgaatatgcttgaggtttcttgtgagtcacctgagaaacgattaataaatgagaactttttataacccacacccagagtatatagatgataatggtgagcggaaagttggaaaaaagtttaaaagagaacaggctattgatatttttaggtagagagaagaagaaaagttcacctcctatttggcttttttttttttttgagacggagtcttgctctttcgcccaggccggagtgcagtggtgcgatctcggctcactataagctctgcctcccgggttcaagccattctcctgcctcagcctcccgagtagctaggactacaggcgccagccaccgcgcctggctaattttttgtatttttagtagagacagggtttcaccatgttagccaggatggtctcgatctcctgacctcgtgatctgcccgcgtcggcctcccaaagtgctgggattacaggcgtgagccactgcgcccggcccctatttggcttttcactatgatcagtttaagagaagacagggcaaggagagaggacatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacatccctgcccttagattctaggaaaatagtaaagaagacgaagaacaagacctcagtgtatccttttactacaagtgactgtaaatcaactataaaattagccatgtttgtaaattaaagttataattttggcccaataatttataatatatctgtttgttgtttgtaggagtggttctgattaaagcccagatttcagagctggcatttcctattacagcatctcagaagatagcgctaaatgctcacagttctctgaagagtattttttcttctcttcccaacatcgtatatactggttgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaattagtctgtaaacccttactttctaaaaataattaactagagctagtcgaagagaataaaattttccgagtgatagatagctatttatggaagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatagaatttaagggctaaaagtatcatatgatctcacctctgagttgttgtggaagctagtaagacatttaaggtgttttcccacctttaccttagaaattaaagctagcaaataaatgttgtatggtaaaactgctaatcagctcagtgaaaaacacattgttttttgaataataggtagtcaaaagctcagatatttttctctttacctcataaattacatgtgtttacaaaatagcactcagtgttttatgctccttatgattatttctaaatattgcggtatctaaaaaccaaattcagatatattccacatgttatcatggcatacttcaagaaaagttatagaagcttaatttgtaaaccttatttctctttacagatattatgtttgttataaataagtgaataaattttgctattactgtgaaagttgcttttgtggaaaagaagattgaattaagatgtatggtaggctgggtgtggtggctcacgcatgtaatcccagcactttgggaggccggggtggggggatcgcttgagcccaggggttcaagaccagcctgggaaacatagggaaaccccatctctaccaaaaaaaaaaaaaaaaaaaaagctgggcaggtgacataggcctgtagtcccagctacttgggaggctgaggcaggaggattgtttgagcccaggagatcgattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatgtcattccaaatgtttctattcaatataagcatttattggacaaaaatgttgctcaatactattccttatggggaggagggcctttgaatctttagtttacaaaatgactgttcaagagaaggacttcacagatcagtatcacctgattatggcataactagtatgaggtatttaagatctcttcctaaactataccacattaaagatgtagtgctagtttgttgtcttactagaatgttgaatggtcatgttaaggcaagaattattattttttatttatttacaagccttttttttttattttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagtgcagcctaaaagcctttaaattgttattagagtccagattatatggtttccttgaaaagaaaatattgaaattaacaaactcccttcaagttatcaagtatgtgactccaaaatcatctacataaatcaatcagcaaactgaataagagaaaactctcattgattatttttctaagactcagtcaaatatttattaggaatccacgtatgttcacatatcacatatgtactgtggatgttatactagttgacctaagtagacttattgtgcccaagaagcttggtagtccatttaagaaacacttaatgaacatttgtgtggcataacagtcccagactatgagtgggttgatcatattttacattggttgtaacttggagctgattttccaatggaagcaacattagatattgcattggagtctcatacgaggccacagacatttattaaattaacatgtagatagcatagttcctgttcttcaagctatcataaaactcaaataccatttttaacaatgtttctacagaatattcagatttacatttttggaatacaagaaatacatttatttttctgtactagaagcaaaaaaccccagcaggtcaaaccacaattaaggctcctatttaggcagcactaggaaatgtttgggtctctcaagaggttatagtcaaggtgtaggctggggctgcagtcatctgaaggcttgactggggctggaggattcatttccaaagtggctcattcgtatggctggcaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctaccaaattctgttcatcagaagtgagttagctgtgcgttggagagtggattagaatgaagctagtgcagagaagcggtaagaggctgttgccttattttggaggggagatgatggtggcttgactagagaggaagtggtaggaataaaaagaagtggacagatttgagaatggtcggaaaatagtttgcaagatgtagtgattggtaggtaaagagagagcacaggtacattgcaaatcattgacagttgggtgaacaataagattatttattaaaacaagtaaccttgggagaaatgttgatcatattgagcttgagttcctgagaggtaacaagttggaaagtggttagatgtaaagaaatgcaatttgcaagagaagtctgggctaggcttataaggttatttgtggtaattgaacttttgcttggtttctgcaccctgttttgtttttccttcttaatcttcagtgattacctctcataatggattattctcactagcctataaagacactcccatatttcttttattaaaaaacaaacaaaatcatccattaacattacatctccctcttgtcccttcgtttttctattctgttttatacccagccaaactttgttaaagagttttaaatatactctctctcccctattatgtcttcagtttcacttcagttattccattctactcctaccatgctgcagaagctgcttttgtcaaagttacacttttgatgttgcctgaggcatggatacttctttcctcactctaactgctctcagttatattcagcatgtcagtccacttcctccttcttgaaacagcctcctccttgctttctaacctgtctctcaggcccttctttctcagcctcttctaccccctctttaaatgctggggttaatcttgagctctcgtctgcgtccttcctcttattctttctgtacattctgcctggatgatcacagctgttttcgtatttgtacttaacatcttcaccctgattttctcctccaggctccagtagtcaggtatcaaattctttgcttgacgtccatctcacatttaaacatacccacaatagactcttgtttttcctaaccacactcaaatctagttctcttcatttttatactttctggaaaatggcacaccatctacccaattatttaggctggaaacctgggcacaatcgtcgcatcattttctcttccctacctcccctatctaatctattagcaagtcctaggaattttcattcagaactatatcacaaattcatccacttttttccatctccactgctaacatcttagtccagtgtatctcagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctacgacctgttgcgcaaaccagcacaccagcagtctcttggtggggctcctcctggccttgcctcctcccctttattctctacccattggcagtgtgattaccctttgcctttgcttcacccatcagtcgtctccttatgcttgtttcctctgcagtctcatctgctgccactcccctgtcgtccagcactctagccacgtggccttctttcagttcttcattttgatttttctccttaggatgttctcgaatgtcttccttctgtctgactccacaaggctggtttcttcatgtcttagattaaatgctgctttatcagagaggcctttcctaaccactcttctttattttctgttatagtagcctgggtgtgcttactgtaatttgtagttgcatactgtcttttctagaaaacatttttactgaagttaaaattcatataccatcaaattaatcttctgaaatgtacaattcaatggctgtagtatattcccagggctgtgtagctatcaccacaaccagttaggacattttcgtcacccagccctttacaaagcctcatactcattagcagtcactctccattccccatgcccctcaacctatggcaactacgaatctgctttcggtctctatagatttgcctgttctagatattttatataaatattatataatatgtgatcttttgtgactggcttcacttagcatgatgttttcaaggtccatccatgttgtagcatgtatcactacttcctttttattgcaaaataatattgtattgtatgcatataccacattttatttatccattcatcagttgatggacaattgggttgtttctactctttggctattatgaatgatgctgctgtgaacatttgtgtacaagtttttgtgtggatatgtgtgttcatttctcttgggtatatatttaggagtggtggaattgctgggtcatatggtaactgtctgtttaaccttttgaggactaccaggctgttttccaaaattgctgcacaattttacattctcatcagcaatatgagggttgtaatttccccatattcttgccagtacttcttattctgtatttctttttgttgcatgtgctttcgggtcgtatctaagaaaggtgtcatttctaagccaaggttatggagatttgctcccgtattttcttctaagagtttagtagttttacctcctacatttaggtttattatctactttgagttaagttttgtatgtgggataaggaaggggtgtaattttattttttggcatgtggatatctagttgtcccagcgtgaatttttgaaaagactgttccatccctgtttagtcatcttggcaccactgttgaaaagcttattttctttcttcttctttttgtagagatgaggtctcattgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttatatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgtcacattaaattcccccgctaatgagcctgtttctgaattctgttctcaatttattttttaaaaatcaatgtagttataaaataggtaccacatgccatgattaaaatgcacactacataggaggttacaaaacaaagagtgaaagtctccttcaccatccaaccctctctcaccagtgctgcttccattgctggtgagaaggttttttgtatgtccttccagtgatttattatgttcatcccagcacatgtgtatccctttctttagaagcatgtggacagaagaatattgttcatgttgttgttccctagagtctatcctggtgctccttccctaatagcacttgcaaatgttcttcattctttttatcagctacatagcattaagatgtaggatgcactgaaaattgttaatccagttccctgtttattgatatgcaaaacagtttatttctgataggaaagaattcagttgaaaaaagtaacttgaaattgtgattgtgaaatatgtgattattatttttattttcatttctaaaaataatttataaaacagtttaatatatttttatattagtatctgaaatttaaaaatggatatagaataaataaaatgtagtaatttatcatttgaagctcttggggaaaaaaaaaaacctttttttccttctaggatgtcacagaacatcctagagttgttttaggcattcaaattaatcctgcataaaaaccaagtgctttttggaattatttttcatttaagcatttcttttatctgaaaatctttttgaaggtcgtgtgttgtttactcttttgtaggccagcgttaatgactgccattgatggaagacatgatgtttgtatccgtgtagaatcaaagctgatagagaagattcttctcaacatttctgcagactgcctcaacagagtgataggtaatatatcagtgtgccatcaagaagttgttttattcaggagtataaatggtatatcggaacagaaagagcactgtactttaaattaagagcttttctgtccatatgaaaaccgaaggataatttagcttaagtgaaatataagcctatgtaagttagaaggttgacttgctttacacctgttagtacatgaacagcgggaggcacctaatttcttcttaacctacatttcctgttggtaagcaaaaactattttacttaactctagttttataagagtgaagtcaatgagtgtgtgacataatatatatgaagatagtccactgtcagtggaatggatttgcaagatcttcaaccgtgatgtcttagttgtcagtggctaagaataaagcaaagataatatatttgtcaggtattcaaactccattcctgttctcattagcctcagatcctctaagctgatgagctaatctggttccgtgattgctttatctttcaatagtagattgtttttcgtgtatttttttagttgggggtgtctagtaattttgggttgaatgctgaacattgcatatattaagtagaacagtacaaactgaggtaaatagtatttgtacctggaaacaggcatgcctctcggtcctttactggaggtgaggggtgagcaggatggtcagtcttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccacgttcttgcacctccccaagttgcacaagcttttgttggttgttatttggtgcatcctaacctggtgggcgggagcagggttgttcctctttgattctggtccagccccagtcttatacaggatgttgaatatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggggttttttttcttttttctttcccccatctgtactggttcctcacctgtaccctggggcaacaggatttggtgtccctcctccagcagttgaaggcttttgttccttaaaggggaggccagatggtgctttgtgttttgtagttggaagctttctctgatgtcttgccctgcccccagtcttatgagcacctggtggaggtgagactactatgtggaagagcctgtgaggatgcagatgttccttatgttgctgacactggcagttcattggctttttgcaattaatttattaataaaaattaatcacattcttctttcctgcctgtatggaggacctgtcttcttcccaaggcctgccccaagggaaactgtgctcctgttccatctccctggaggcacctgtctccttatgtttcagtctttttggctgttttacaaccttggttctcatgtgtattcaagaaaatgatgatttgatatttattcaattttttccagtaactgttagggtaggagccactttttccagctttctacatcttaattagaagcctctctccgtttttttcccccattttctttatttcatttttattcttttggctattttcattccttttcttaatgttacttatatattttcagtgtaatctcttcttttttttttttttttgagatggagttttgctcttgttgcctagactggagtgctgtggtgcgatctcagttcaccataacctctgcctcctggattcaagcaagtctcctgcctcagtttcgcaagtagctgggattacaggcatgcgccaccatgcccggctaattttgtatttttagtagatatggggtttctctatgttagttaggctggtcttgaactcccaacctcaggtgatctgcctgccttggtctcccaaagtgctgggattacaggcgtgagccaccgtgtccggcctatctcttcttttttgcataatgtaaattagtctttatctcttagagaagcatcattctcatatcacatatacttcagtgttttgtccattcttgagacaattaaagttgtactacttggcattaattagattgtgatcataagtcaaaatgtcattggttataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacggtctgagcatggttgatggtgctctgtcattctggtattgaacaacctgccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcacttttctgatgtactgcagcataaccagaactgctgtcggtctgaacggtgtgttatctgggcctgtttcttgtgtcagggggatcacatgccgtcactctggagtgcctcaatagcttgtaactagaaagagaaggtatagaaagagtagtttacttacctgtttatttatttagagacagagtcttgctctgttgcccaggctggagtgcagtggcacaatctcagctcattgcaatctctacctcctgggttcaagcaaatctcctgcctcagcttcccgagtagctgggattacaggcatgtgccaccactcccggctaatttttgtatttttagtagagacagggttttactgtgttggccaggcatgtctcgcactcctgacctcaagtaatccggctgcctccgtctcccagagtgctgggattacaggtgtgagccaccgctactggacgggaggagaaatttaaaatgggtttgagacttgaggaaccaaaagaaacaatgaaaccattcaatgtgtgtgctcctgtcaagctagcagcgatcttgggagctctgtgtttttgtcttttgcagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtgcttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaacaagcttcttttactctgtgtatgtttttaaaaattcctttggttcagaggtggtggttgttttttaacttggcttccctaagaatgaaccacaagagttttgtgattctttcaaaaataatatgccaaaatgactttgtgggagcacacacacacaactgcatgtttctgtggagaaggatccatagctttcaacaaatcctcagagggttctgtgaccaagaaaggtaagaacaaggctttaactgatgagtttctttgtgggggagataagggaattagagcaaatgattgccaaagttttgtctagcaactaataaggtgggtacagaaagaattgactccattttgtatctagagagactggaattcaaacaaaatcattggctcccttcaatgattcgttgaatgggtgatgaaacttgagcctgtagttgacaccttctaatctgtgctctctcaactataaccacactaggcggatatttggaattctgatataaaatctgcccagtcaatataggccaaccaagagagctgttcgcttaagtgtgcccttccccactttgtcctcaagtggagacctaatccctacatcaaccagaacataatccccaggaacagatggctcttcacatcctattgggaagaaatctttaaaccatttcaggtgagtcaacagatcacaccaacatctcttcacagttgttggtatgtatttcattcattaacacatatttccaggagcccttatttaggttgggaactgtttcctccaatcctgaggaatctgagctatctacagaagttatgagctatttaagtgggatcaggatcagcccattgctcctgctatggtctgaatgtgtcctcccaaaattcttacgttgaaacctcatctctgatggcattcagaagtggggcatctgggaggtgattaggtcatgagggctttgcccttgtgaatgggatcagtgcccttacggaagtggcccgagggagcttctttgtccccttctgccacaggatacagccagaaggtgtcatctttgaagcagagagcaagccctcactagattctcaattttctggcaccttgatcatcccagccttcaaactgtaaaaaataagtttctgttacttataaattgcccagtctgttattttgttatagcacccagaacggactaagacaccttctgtgtgtattctttacctgagttgacaagtaagtgtctttattctgttatgttttcataaaactcagtggggtagccagagtgtcatccagcagtcccatatctggcagtcttatggtgggcatttcagggagacctcattcttcatcttctgatagttcagcttgcagggacagctctcctatttttagagaaccatttttatttgttagtcacttagtttccccaaaggtatcctttttctaaaagcgttagaggcattcacctttctccccactagtaagatctgtgctgtttcattttacatcttttttttttggttgggggaaagggggctgatcatcaaatgagttgacaacattgggtgcatgatccaccctgcagacgttcgctgaatgtctaccatgtgctaggtactgggaatgcaaagacacaaatgtctgccttctgtaagttcacaggcaagctggtgaagaaatatttaaacaaaattatatcagcgccaggattaaatctgtgtggaatacagagccaaggcaaaagaggtaacagtaggatgggtttgttagtcgtgactcttggttgcaagtgataaaaacccaactcagagtagcttgagcaaaaaagggggacttgattgactcacataaatgagggtagtaccagcttaaggcacagttgaatccattggcctaaattacctggttaccccaactccctaatttatctttctttcttttttctttctctctccctctctctctctctctctgtctctctcatcagaagaggtcttttacgctgttattgcaaaagcatagatgtttctacagagttttgataggataacattttcacagtgattataaatttacatcatccctagaattctaaactactgggatctgaggccgtaaggtgtttaagagtattctgacattaccttagattcagcaaaacttgaatagttgatcatgcctttcttagaagaaaatatctgtaatttctcagaacaatatagaatgagacagaaaaactaaccatccctatgtgtcttattttaagtgatatatttgtatcctgatgggtttctaggtgttggaacacaggtcatgaatcatagaacaattagaataaagtgttcgtctttatcagtagcttaattctggcccttcatttaatgtcaacagggtagaaatgtgtgagaggggatgaggtttgccaattaattgtcattatgtctttggaggtcttgaacctgatttgttattatgaagtgaattctacccacttaaggcatacatttgctaaaggtgacctctctgcttccacgttgttaagaaatcgtgatttttttcaaaaccatcatcagctttacagtttttgaggaaagatctagaagcctgttaaaatggagttaccaggcagggttcagcccaggaaaccgaagccactctgggaattctaaacagagagagattaatgtggaattcaggtgtttgcaaaggtattggaaggctggaggagcaggcatcagtctgagctccaggaggctgccacgtgaacggtggattcatgaaaacatcaccattggctgccatcttagactgaggatgcagctgctgccatcctggcaactgactctcaagcacatggaagctgggagttagttgctgctgcccaaaactcagtccccacagctacacttgccaggaacagtagcttcaggaagatagcctggatttcactcatcttccatattgcacatgtgtgtgtttcattgatggaacatgattcacactgagagctttagctgcaagaaagtttgggaaatatgtcttctctgaggcttttggtctttgcagttcaggagcagttaggaggtgggactggttggttgcagagtgagctgatttactgcacttagtctagcttattaaaggatgagcttataaacaccccaggtaatatcataatacataagtgctacctaattactgtgtgggtctgttaccaagaatgtctaagtcaagaaattgaagattgtttccttaagattctgcatcctaatgtagaatctttcctattagagtataagtaaattcttttggtatgttatttaagaatatttgtgaataggcttaattaaacaccatgttaagaaattataaacttaaggccaggcacagtggctcacgcctataatcccagcactctgggaggctgaggcgggcagatcacttgaggtcaggagttcgagaccagcctggccaacatggtgaaacctcatctctactaaaaatacaaaagttagccaggcgtggtggtgcacacctgtaatcccagctacttgggaggctgaggcaggagaattgcttgaacctgggaggtggagcttgcagtgacctgagatcacgccagtgcactctagcctgggcgacagagtgagactctgtttaaaaaaaaaaaaaaattataaacttaaaaaaaagaacgttttcctttaaacaaaaatgcatgttccttgttttttgttttgttttgctttgccttttttgagagacagtcttgctctgtcacccaggctggagtacagtggcacaattatggctcactgtagcctctacctcctgggcgcaagcaatccttccacctcagcctccctggtagctggaactgtaagtgcagaccacaacaactgattttttattttttgtagagacagggtctccctacgttgcccaggctggtcttgagctcctggactcaatcgaccctcttgccttggcctcccaaagtgctaggactataggcatgagccactgcaccaggccgtttcttttttttttaaactttggaaaatatggatgaacgaagtgagaaaagtaacccttctgttattctaccaaccaaagctaattgctgccaacattttaatagatattccttcagttgttttatgcatgtgtgattttatacatgtgtctactttaaaatatatagtctttcaatgttgcccaggctggactcaaactcctgggctcaagtgatccatcacctcagcctcctgcatgtatctacatcttattttattttatttttagagacactctgttaaccaggttggagtgcagtggtgtgatcatggctcactgcagcctcaacctccctgggctcaagtgatcctcctgcctcagcttcctatgagtagctgggactacaggcatatgcctccatacctggatactttttgtattttttgtagagacatgtttttgccatgttgcccaggctggtctaaactcctggcctcaagtgatcccctttgcctcagcctcccaaagtgctgcgattacaggtgtagactaccacgtctggccaacattctcattgatagtctttgcacacatctttcattccttctgggaatttattctaagaaaatagaattttggggtcaaagtacttgtacgtatgtatctgtaccaggaaaaaagcagaaattccagtatcaacagataacgagagccaagcaaggtggtacatgcctgtagtcccagctactcaggaggctgaggcgggaggattgtgtggcatgagcccaggagttagaggctacagtgagctatgattgcaccactgtactccagcctgggcaatacagcaagaccctgtctctgaaaaaacaaaacaaaacagataaccattgttactattttgttgaacattttccagataccctgatagaagacagatctgtgcatgcacatacacaattttacataaatgggaccattccatataggccagtatctagtgagtactttttttactccacaatttgccatatatgtctttccaaatcaatcaacatagattaaatcatatcaactacacaggattccatcatctgtgtgtgctcttgaatcctacttttaaaatgttctcagaaaggttatcctgaaatatattcctatcagaagttttccacactctctctaaactgaatggcataagtaaaagactagttgttaggtttaaaaaaggttatctgttttaattggaattttttttttgaggttttctttttcttttttctttttcttttctttttgagacacagtttcactctgtcacccaggctggagtgcagtggtgcgatcttggctcactgcaacatctgcctcctgggttcaagcgattctccagcctcagcctcctgagtagctgggattacaggtgcgcaccaccatgcccagctagtttttgtatttttggtagagacaggattttgccatgttggccaggctagtcttgaacttctggcctcaagtgatctgcctgcctcagcctcccaaagtattgaggctacaggtgtgaaccactgcgcccagccttaattgaattatttttttgctaaagtgattgtacatttgtttcatatgcttatcagtcatttgcagtttgctttttcatattttaccttagaccatttttatttgggagaagccttttattaaattagtatgttctccttataaagttagtaatttttaacatgtgttgcagacatttttcccaagcttgttatatatgttttgacatgcagaaatcataaatatttacgtggatcaacccatcaatctttttctttattgtttctagattttatgacatgcctagatagcttcttttctactataagattatacacattttcttcaaaaaattttttgaaacatttatgattgttatatttgtatttaaatctttaattatctaaaatttagtgcatggtatgaatggatctaactgattcattttcctaaaatggtcagctggttgtcccaacactattgatttctttctttcccatcagtgacgtagatgtgatctttattataatatgaaattattattcctgctagcattacctgtggactttctagtctgtttcattgttctatatttattgctgagccagaaccatacagttagaattattataactttacatctgataggaaaagtaccccatatttttcttcattaaaattgtttttctcagacatctttgcccatctgttcttttttattccccattacgagtatatgttgcagtgttttttagtatattcagagtgtgtgaccatcagcacactcaattttggaacatttcatcacccccaaaacaatcatccatagttacattaactataccaccccacagctcttccttaagaggagctaacagtcgctcctccataaccaccctctttcccccaaccctaggtaaccactcttctacttagtggctgtatagatttcactattctgacatttcacatgaatggaatcatacaatatgtggtcctttgtaactgatttctttcactcggtatagtgttttcaaggttcacacatgtagcatgtatcactacttcattgtttttattgccaaataatattccattgtatggatataccacattttatgtatctattcatcagttggtggacaactgagtttttcccactttttggctatttttaattatactatcatgaacatttgtgtgcaagtctttgtgtggatgtatattttcatttctcttgggtatgtacccaggagtggaattgctgggttgtatggtttaaccatttgaggaactgccaaacttttctaatgcaggtgcactattttacattcccatgagaatgcattggagttctgatttctccacatcctcaccagcactttttattattatctgactttttgattatagccatcctagtgggcatgccatctgttcttgagataagtttagaatcatttttatcccattgatatttttaatgagattgctttgaatttatggatcatttggacatgttttcagtggttaaggcttactatttaagaagagcatgctttttcaattaataaagtattctttaatgttccttagctttagctttatttagcagtccacatttaaagggtattaactatggaaatttttttttttttgatacagggtctcactctgttgcccaggctggagtgcagtggtatgatctcagctcactgcaacctctgcctctcaggctcaagctatcctcccacctcagcctctttggtaactggggctacaggcatgtgccaccacacctggataatttttgtattttttgtagagatggagttttgccatgttgcccaggctggtctggaactcctgggctcaagcaatccacctgcctcagcctcccaaagtgcttggattacaggtatgagccatcaaccagtttttttgtttttttaaatcattgatttcaactatgctctgttgaatcccttttccatcccctcatgtctcacatgcctcacataacttcccaggcattgtgttttagaaagtctggtattgtttaaattccagcctcattttgctcttctccagagcatgtccagctagtcactaaagggacttggaatggggaggagataggtgcactcttcctttcctttgactccagctgttggagctggagggagggcgtgaactgtcaccgaggtgaattctccccattccttcccagcttcctgaggcctagctcctccagtgagctggggagggagaaaagaaggaaaggggacagtggtacttaccaggcagctaccactgtggtcctctcctttgatggactctgcttttctagccagtacttaactgctgatgccttctgtgcagcaggcgttgagtactcctctttctggggtccatgtgagagttctttcagagctcactcttctatgtactctatgtactcactctatcatatgtacacagttgttttcatgggagatgcagctctgtctggtctttcctgccccctccactctctccaactgtacctcctttctccatcttgcaatctctctctgattcacttcactcgtgctcagacaggcatggagagcaggtcagcaaattcttcacactatcagactttagacaagctaaggaattgtccttctctgcatactgtatatagcacagtttgatttatgtaacatcctaatcatactgtctggaagaatcttaccaaaatgatatcattattcccctacatggggaattagggcttgattttaccttctttattataattatttttacttgatcaaattactaggaaatattccctcacttctaaagaatacaatttccctgtgttagaaagatcagtcccggtgtggtggctcactcccataatccctgtaccttgggagcctgagacgggaggattgcttgaggccaggaattggagaccagcctggacaacatagcaagatcttgtctctataaaacactaaaaaaaaaaaaaattagccaggcatggtgacacactactcaggaggctgaggcaggaagatcacttgagcccggaagtttgaggctgcagtgagctatgatctgccactacactccagcctggatgacaaagcgagaccctgtctctaaaaaataaaaacaacaacaaacatacataaataaagagatcacatccaaataatagaaaaagatgatatggttttggtccccaaaactgacatcacgtaggagatattggaactttgtgggtgggagccaagcccatgctggtgccccttctctaggtcacgtctatactgcttgtttggattccttggcaaaaactgactatgcaaagacagtaggatgcctgactcaaattgggtcaatcagatcctttttcttggaatttaaaaaaaaattgcatgaaaacgtatagttaaatgcacaggtcttaagtgtacaatttagagttttgacaaatatatacattcatgtaactgaaccccaaacaagatatggagcatttccatcaccctagaattttcgttcatctccacttccagtcagtctccatccatgatggccaaccaccattctgatttctatcactatacactagtttgatctgtgtttggacttcatgtaaatgaaatcatacagtatatattcctttgtaactggctttttttaacctaagaatgtttttcaggcttatccatatttttatgtgaatcagcagtttattcatttttattgttcagtaatatatcaatgtgtgaatatattatccattcgtctgttgaagtcatttgagttctttccagtttcgaactattatgaataaagctgctaaaaacatttttaaaacaagtcttgttgtggacgtaagtttttgttggggcagggatttaaatagctcggactgagattgtcagtttattggataagtatatatttaacttgagaagaatctgccaaacagtgctccaaagttgtgcaattttacactctccgcagccaaaacggaggcttccagttgttgtacatccttgccaatatttgagatgtcagtcattttcactgtagccattctagaggcggtaaagtggaacctcctggttttggtttctctttcactgatgactaatgacgcacaacttttcatgtgctcattggccatttgtataccttcatttgtgaagtgtctctcaagtcatctgcacatttatcttattgggttgtttgtctttttactgatcagacatatgtattctagataaaagtcagatatatgtattattgatatttcaaagcattttgttcagcagtagaaatgctggctatatgatttgagaataaaaatacgtatgtaattgtaacaggaagtcttaaataaattaaaatgtcactattttgaataactagaatatatattaagaaaaataatcccaggaaataaaaaatatgctagtaataattacacataacagatttacaaaattatattaccatataacagtaatacataattctaaataaaaataatcatgctcacagataaaaccaaaaactttaagagcttaatttattgaaagcaaatgatttaaatatcatgagggaaataaaaggagacaagaattagtggaacactctactgtgctcctgctgtttgggaagatgtactatacagagttaattcaacaataaacaaagtccctgagggatggcctatacgagttgacaagttgatttaaaaattaattgagggaattaaacagaaatgtaaatattccaataaccatcgaattatacattttaaatggatgaatcatatatgtgaattatatctcaataaaacgattataaaaaaagaataaacagggaatttttttctttttgagacagagttttgctcttgttgcccaggctggagtgcaatggcatgatcttggctcaccgcaacctccacctctcaggttcaagcaattcttctgcctcagcctcccgagtagctgggattacaggcatgcgcctccatgcctggctaattttgtatttttaatagagatggggtttctccatgttggccagactggtctcagactctcaggcttaggtgaacctcccgcctcgctctcccaaagtgctgggattacaggcgtgagccactgcgcctggcctaacaacagggaaatatttttcaagttaaagcaaaaaaacaaggtaagccaagtaaaactatataaaaatatatgattttggtgtttacagtgcattgggtaaaaaatcttactcagaaacagtatgtaaaatatttcgtttttagaaaaccatacattaaatcaatggagagtggccaaaaaattttaacactgtttatctcaaggagctacaactatggtaaatattttccttaataatgaaatgtggaaacattcctgagaacagaaataagacgaagatgtccattatcatcacttgtattcaatactttcctggtattcctaacaagagtaataaggcaaaaaagttgaaataaaaatactaagattggacctaagatacaaaactatgtatgtattattaacaactcaaaagaatccagagacaagttattagaattagtgagtttagcatgactgaataaatggtcaaaataggaaaaccaactttatttctgtacaccagcaagagttagaaaataaaacattttaaaacaataccatttatggtagcataaaaattcaaatgtctggggaaaaatttaatgaaaagatgtccatgacactttattatttagagaaatgagagaagaggtaaataaacagaagtacataccatgtgaactgattagatgacccagtattttaaagatgtcaattctcccctgaattgacttataaactcagtgcaaccccaggcgcagtgcctcacgcctgtaatcccagcactttgggaggctgaggcgggcagatcacgaggtcaggagatcgagaccatcctggttaacacggtgaaacccccgtctctactaaaaaaaaaaaaaatacaaaaaataagccgggcgtgatggcgggcgcctgtagtcccagctactcgggaggctgaggcaggagaatggcgtgaacccgggaggcggagcttgcagtgagccaagatcaggccactgcactccagcctgggcgacagagcaagactccgtctcaaaaaaaaaaagaaaaggaaaaagaagaaaatctcaatgcaatcccaaccaaaatcacaacaggcttcatatatatgtgtgtgtgtgtgtgtgtgtgtgtgtgtgtgtgtgtgagagagagagagagagagagagagaagttgcatggttaggtggtaaaagcagtgtttgccataaaaatcaggtcgttggttattttggttattttggtggggagggagaggtagtgtttggaaggggacacgctggaaggttttgggacgcatggtatacccgttgtcaatgtatggcctcgcacctccaaatccatcctttaatacctgctctgcggtcacagccagaatccccttccgcggctcccctcgcggcggggaggatgctgaacagtagagggcgctggagacacgctgcgggaggctggcgctcgggtccggctgcgggccacaggccgcggatcgcgttctgccagcgccccacgcccgcaagcgcggcccctccgccacctcgcggcccggcctgacctgttaatcacgtccccacggctcttctagcggggacaccgccgtctgcaggctccgtccccaccgtgcccagaccccgggaagtttgtcagtcagcaccctgatgccagccgattctcaaaaagccaggaggatccaagcagatcatttgccagacggtactgcagcaatggagatgaacagataattcacacagaaagaaggatggtagggagagacgtgcggggggtagggagggcggaaggaaggtctaggggaaggagcggagggggaagggaggaaggaaggcaggaatggaatgaaaggagaagggaggaaggactcgttgaatgcacagcctccccggtgctgcagcggcaggagcggctctcacaggcatggggcccccagcagaccctaccaggctgcgggaatgttgcggccctgcagggcgtctctgtcttttttgaggtgtctctggtaatatgtgataatgatagtatttttagacatttggaatgtgatttaaattctagctccaccaccttctagctgtgggaccctgagaaacagcacatcctcccagatcctcccttctctcttgtccacacgtggggaaggctcctggcggggtggggattgggggtggtgggaggggggaaggtggggggctttgcagatttaccaagctgatgtacaaagacctactacagctgtaagggctagctcctttctcccactctggcagtcactccactttgagaaacatacctcttgaaataaagctacaagtggagaggggcaggtgatttgggcaaataattccatactaaatattaggacaaaacatcctaggcaaatatcacaatccggagtcatagtggcatactaaattcaaccaagaaatatacccatgatgttgaaagagccaggcttatggaatgtaaacagcaaactattttattcttgttttctatttaccaattcaaacttgctctgcaggtcactcctccctgcccctgggataaaatctagggcatgttctgtgactttctggatcacaaaattcacatgatttttggatcattctcagttaaccaaaaatttgtcctgtaacttctagctataaaaataggctctgttcagcatttaaaatgtccaatcccatgtaggagtctaaactttcgatttcattttaagtttaagcttcctcttgattcctcccccaagcctggcccaggcttgcatttggcttcaggcattgggcgggtagcagtgtttcctctccatttttcactttcactcttccctccccaactagcttgcagggatttctgatcacctagtagagtctagaggcgtaagggaaggaggtcaccaaggggcaggccaggctttatgtgaatagtgctgttgtgagccaagtacttgagtacttcgaggtccccttctactgcagacatcttccctatggttcctgtgacccaggtttgtctcagagtggggttagcacacggtaccatctccatcccctttaaaagtatttattacatttttctggaaatggaagtctggaaattatatttccctgatagtcttatgagcaggattccaggttgattctgccaaatgtgaggcactcaggtgagactagaaagcagaaagatggtttaaaaaatcatcgttttcttcctttgactctgcacttacgacagcaggatgctcgagactcttgcagtaatttgggcaaagatttccacagtgcaaaatagaaaaaacaactggcaaatagctgtacaaattacagtccattttcatcatggaatgtcagtttggcaacaatggcatcgaggccccaaagcagctctgcagtaggggggttcctccttggtgactggatgggcacagccaagcacaggctcctgaagatcccagctccaggaaacatcagcatggttcattgcattgtccacctgaattcttcacccctccctgtggctgtgtccattgccctgtagtgttgcagttcccctcaggaaaaagatatcatttacttctctgacccttgatttggagcttggctatgtgacgtgctttggccaatgggatattggatgacacaacataaggagagacacagatatgcatatgcacaatgcagcttgcctttttatgcttctcccttcaccacgaaaagagctttccctgggggtagcagctgtccctgcagcctgtgttcagaatgcacaaatgtgaggagccaagcccagccagcttgaaagtgagttgccaggcccggcgcagtggctcacacctgtaatcccagcactttggggggccgagacaggcagatcacctgaggtccggagttcgagacgagcctgaccaacatggagaaacccagtctctactaaaaaatacaaaattaggcctggcgcagtggctcacgcctgtaatctcagcactttgggaggccgaggcaggcggattacctgaggtcgggagttcgagaccagcctggccaacatggagaaaccccgtttctactaaaaatacaaaagtagccgggcgtggtggcacatgcctgtaatcccagctacttgggaggctaaggcaggagaatcgcttgaacccgggaggcagaggttgcggtgagccgagatcacgccattgcactccagcctgggcaacaagagcaaaactccgttgaaagaaagaaaggaaagaaaggaaggaaggcagacaaaattagccgggcgtggtagcgcatgcctgtaatcccagctactcaggagactgaggcaggagaatcacttgaacctgggaggtggaggttgcagtgagctgagatggtgccattgcactccagcctgggcaacaagagtgaaactttaaaaaaaaaaaaaaaaaaagtgagttgcctaccctagctcagaccacctccagccaacccacagatgtgttagaaatgagtgcttatttaagtatggcattgacatgttgtgattagttgttatgcaccattatagcaaaaaaattgcacactgataaaagtaactgttccctcgttggcttcaccagctttcccaagaattgtttaatcccattccgtgtataaaatcactctctgctgagaatcctttttctgagaaaagaattctgagatttttttttctgcttgaggcagaccaacactcattccaagaacaactggaaaggctgaataaaacacagaaaacttttttaaaaagttttttgaaagcttcccagttaacaaacatttgaagggccataatctcaaaagaagaaaaacacaaggaggcaagctggccctctgtgaactacttttcctttcaggaaacgtgctgattttagctaagaggccgagcatttgggcagacggccatagctaagaggcagcaaagtcagcagagtcttcagctggagagacaagaaatggagactgaggttgtcaaggcagctggaactgaaggggccgagatatcatgtagaagggagacacagaaaaggaacactttccccttgaggcatctgctgaattaagctatgcagaaaggctatgaaaggcagcaggttttggcagtgtcatattaatgagataaaagttggagttcaggacccaccaaggaaaagaagcctaataatcacatcagacgctcagctggaatccttggaggaccacactctagatagatgggcaaaccagagatggagatgaagccttccaaaaactgcaacatagactctagtcagttcagtaccattggattaaggtaaaatcttcccactctgtctatcagatgacatggtaaaccctcccttgagacagacattgttttcagataatgtttcctggagccactaaaatttattataatggttagcattcaacaataagtgatcaaacacaccacaaaacaggaaggaggggaaaacagacacaacaaaacggagccactaatgacccagatattggtgttatcagacacagacttgatgggtggaatagagactttcatcaaagaactggaatctataagaaagaatgaaatggaaatttaaaacttaaaaatacaataactgaaattaagtacttagcatatgggttaactacaattagatttagcagaaggaacattctttgaactgtaatacaggacagaataaaaactctaagctgaaaaacagagacaaagagtatggaaaatacagcaaagaacataagatacttgtgggaagtggtgaacaggcctaatacatacgtaactggagtcttagaagaagggaggaagatggggcagaaggaacagttaaataaatataggctgagaactttccaaaactgataaagctttatgatccccaagcaggataaataaaaacaaaactgcatccaggcacactatacttttttattattattattttttgagacggagtttttctttgtcacccaggctggagtacggtagtgtgcgatctcagctcactgcaacctccgcctccccaaggtccagcgattctcctgcctcagtctcctgaatagctgggattacaggcacgcaccaccatgcctggctaatttttggattttttagtggagatggggtttcacatgttggccaggttggtcccgaattcctgacctcaggtgatccactggccttggcctcccaaagtgctgggattataggcgtgagccaccgcacccggcccaggcacactatacttaaactgctgcaaatgaaagacaaggaaaaaacattaaaagcagctagaggcaggtaggagggacacatttcttcttttcttttttctttcccctccctccctctctcctccttcctgcctccctcctgtcgttttcttttgtagagtgggggatcttgctctgttgcctgggctggttttgaactcctgggctcaagggtgctgggatgacaggcatgagccagcgcacgttactgacacattactctcaaaggagaaacaatagcactgaaaatcacttgtcaacagaaatgatggaagtgagaagataatggagtgccattctgaagttcctcaaagaaaaaagtgtcaacctgtaatcctatattcacaaaatatacttaaaaatgaatttgaaatagatgtttctattcaaaaactgagaaaggctgggtgaggtggcctgtaatcccagtcctttgggaggtcaaagcaggcagattgtttgagttctggagtttgagaccagcctgagcaacatggtgaaatcccttctctacaaaaaatacaaaagaattagccaggtatggtggtgcctgcctgtagtcccgctactcgggaggctgaggtgggaggactgcttgaacctaggaggttgaggctacagtgaaccatgatcatgccactgcactccagcctgggcgacagagtgagaccctgtctcaaaaacaagcaaacaaaaaaacacaaaaaaacctgagaaaatttgctgtcagcagatgtgcatacacaaaaaatactaaagggaattcttcaggtagaagaaaactgatctatgatagaatcacagaaatgcaggaaataataaaaaaaaacagagtgaatatgtgggtgaatacaaatgaatattgactgcacatagcaataataataatgtctcattaggtgtaaaatatatgtgaaattaaaatgagtaataataatatacatgcaagagtagaatggaggtaaatagagattgagtattgtgagatcatagcattgtctgggaaacaataaaaagtaaaatttgtattagattataataatgtacagaagttgtaatctgtggaggaaaccactgaagaaattataaaagaatgtgtaagtagaaccaatggtagggggggaaacggaattaaaaaaataatcagaaagaaagcaacagaaaagaaaaaaataaaaacaaaaatgggtaagacaaatggaaacaaatagtaagatggtatttatgaacacaactatatcagtaattacaataaatgtaaattcacgaaatacacaaaagacaaaaattgacagacttgattaaaacaactctattcaagagacatgacatcattataagaacactgaaaattcaaaaataagggggaaagtgaaaaaaataccactgtgagtggtagagaaagccatttcacataataaagggttcactctaccagaaaacgtcaattttaaatgggtatgaacctaataacacaatctctaaatgcataaaacaaaaattaacaaaactcaaaggagaaataaacaaattcataataatagtggcgggctttagcctctctcagtaatttatagaaaaacagacaaaaatatcagtaaagatgtagataatttgaccaacctgattaacaaacttgacccagttgaaatacacataacacctgcacacaactgcagaatgcacattctttcaagtgcaagaacattatgataagaatattataggaaagtctgtcataaacatagcttatataaaaatgtaacagcaaattaatctaaattttatttatttatttacttattttatttttttgtttatacttatgtcatagtttatataaaaatataacagcaaattaatctaaattttatttatttatttatttacttattttatttttggagacagagtctcgctttgttatccaggctgtagtgcagtggcgtgaacatgactcacttcagccttaacctcctgggctcacgcaatactcctgccccagccctccaagtagctgggacaacaggcatgtgacaccatacctggctaatttttgtggtttttgtagagaccgagtttcaccacgttggtctcaaattcctgagcttagacaatctacctgccttggccttccaaagtgctgggataatagatgtgagccactgagcttgacttaaatctaaattttattttattttattttatggccatgctccctctaataaatctaaattttaaataaataagtccaagtattattgtgtttatgtgtataaacctgtgcacacacacaaacgcgtacacaccctgctggtttctattacaagaatgttaagtttggtttgacattcaacagtcaattagtataagtcatcacatccaaagaataaaggagaaaaataaaattatttcaaaaggtgcagaataagtatttgagagaaatttaacctcatttgtaattaaaaaaaatctttttaacagcttgagaatatatgttaatgagtacattaaaaatcctataacaaccatcaaacttcatggtgaatattgacaactctccacatgccacacccaccacccctgagattgaggatgagacaagaatacccactatcactacttatagtcagcattctgctggaggtcctagccactgcaatttgtataccaattttatatcttgcaaccttgctgaacttattagctctagtagtttttttgtgtgtggattccttaggattttccatagacaagattatgtcatgtgcagatatagttttacttctttctttatgatctggatcacttttatttctttatcttgtccaattgctcagcccctgcagtttggcaagagctaaataaggcataaagattaagaaaggaagaaataaaactgtcattcacagaggacatgattatacaaaaataatctgcaaattattataatttaaatgaatgtcacaaggccactcactggataacaaggtcaacatagttttgtagcaacagaatctgtatatactagccataaacaaatataaaacgtctaagaataaatctattgaaggatgtgcaagaacactttactgaaaaccacaaaaatagttctgagaaacatacaaaagacttaaagtgaagagatataccatgttaatgaataggaaaattgaatattttaatgatgtcaaatggcccccaaattgttctacataatcaattaaatccaataaaattctagcactttattttgtggaaattgactagctgattctaaagtgttttatggaaatgtaaagggcttctttcttctggagttgccttgtggacaggatttgagacaacccaggccaggtctctctggtccatggaaagcatgtgtatgctttttgccctgactatgtctgtagagaacaaccaaaacaacaacctcctccccatcagagagccagctagtctcttgccatttagatttttcagggatgagtcagagataccagtctactctgtcctgcagaaaaggatacttatcaacttttccacgtggccctagaaaagtcactgctagtcagaaatctcactttggaatgtgggggtggctggcatctatccggatgtcagatgaaacaggaacagttccactgtagtagcctgctctataaacacacagagaacccctattacatgtgaactatgaagctattagaaactacagctttgtggactactttgaaaatgtgcaagtgggccgggcgtggtggctcacgcctgtaatcccagcactttgggaggccgaggcgggtagatcatgaggtcaggagatcgagaccatcctggctaacacagtgaaaccccgtctctacttgaaaatacaaaaaattagcagggcgtggtggcaggcgcctgtagtcccagcgactccggaggctgaggcaggacaatggcgtaagtaaacccgggaggtggagcttgcagtaagcctagatcgcgccaccgcactccagcctgggcgacagagcgagactccgtctcaaaaaacaaacaaacaaacaaacaaaagaaaatgtgcaagtgaaataagtgacaaaaagcaaacacaagatattctgtccatacgaaacactgcgaggcgacacttgtatttgtagattgacagaaattgcaggtggagttaaagaggtacaaactcagtataacattcattgcctcttttgctaaagttgtttcactgcataagaaaaagatactggtcgggccgggtgcggttactcatgcctgtaatcccagcactttgggaggctgaggcaggtggatcacctgaggccaggaatttgagaccagcctagccaacatggtaaaattccgtctctattaaaaataaaaaaaattagccaggcatggtggcgggtgccagtaatcccagctacttgggaggctgaggcaggagaatcgcttgaacctgggaggtggagggtgcagtgagccgagatcacgccattgcactccagcctgggtgacaagagggaaactctgtctcaaaaaaaaaaaaaaaaaaaaaaaaagaaaaagaaggaaaaaagagaaagagatagtggttccatgtgctgttctagttacgcaaaacaacgtgttgacgtgcaggctgcacgatgccaggtgcaaatacacactacctgttacagtaactgtgacaagcacaagggctgctcactagcttgagtgcaacttctggggagttgatggcagtgatctgtgggtacttccttcttaacaaattttacatcaatactgcaacacagcaatctcagccctgtgggctataccatagccacatgctttcaccatttcctgctcaaagggagagcccaggaactgaatgctcttaatcagggagagcacagaaacagcagcagaacagctggagaaccagggctgtgtggttttggactgtggggagggtgggccatgggcagacttgacacaatgtgggagggcatttgacacagccccgtggaggacctaatgctcagggaggccttcacccagcacagtgagccatgccgacacttggtgcctgagtgtgctggtcacagcgccctccctgtgattttccccatagcagtgtgttttctctgccaggcagaaggcagagaaaccctggctgaaaaagcagtgagggtcatcgactgcatgaacacatcatcagctttcccagatggaggcacccaagtttaccctgcaggtccattcagcaggtagagctgggtcatcactaaacaggatctttcttctgagcacctgagattctggtccaaatcagggctgtgaggaccaggggctgggattccgagcccaggcagccctgcaggcaaggaggagggagtgtgtcggaaggctgtatggccagagccgctgaccgggccaggacttctttgtcccctcttctctcctgcatatcagcactcacgtcctcctggctcgggctggcctggcagctcggggagctgttggatgaaacgtccatgcgtgtggctgtggctgtcacgtgcaactgcgaggatggtcggctcccaaagcggaaccgcggtgctgggcgaagggtcagggctccgtggtgcggcagagcgcatgccagcgcttcaccagctccttgggcttgctgagcatctcgtcccagtgctccagctctctgccacgggtgtacatgtaggggcccaccaccactcagcccagctgctggctctctgcaggggagggagagcaccagtgtgctcctgagcacagaagccccgtccccagtgacctcctttcctccctcctcctccccaggaggaagtagcaactcccctcctctctgagtgggagctgacggcccccaaaggggccctgcctttgctctgcagctggaagggctgcttctccccctgggagattgggaggaaggagagccctgaaagactctctccttgagggccaccagctctgacccacacccttctgtggggccgtattaagtctaccttatgccaaagagctgagggaggaaagggcccctctagaaagaaggcctcggccatccgagagtacattcagcagtaacgttcactggccactgtggagaagggtcttaagtccaggccatgtggccagccacggcctgatggctctgtttccccagagtggcagtgggtgctggggtgtggggcagtgtgggagagctggctgacagaactcgcccagaaccccaaaggctcatctagagggcacgaggaaggtcagagcaccaggtccctgggctggtggcagccctggtccctcccactctctcgggtgatttgctccagaagagggcagcagaggcgattgcttaacctctttctttttcttttctttttttttttttgacagagtctcgctctgtggacaggctggagtgcagttgcacgatcttggctcactgcaacctctgcctcccgggttcaagcgattctcctgcttcagcatcccgagtagttgggactacaggcgtgcaccaccatgcctagctaacttttgtatttttagtacagacggaattttactatgttggccaggatggtcttgatctcttgacctcgcgatccacccctctcggtctcccaaagtgctaggattataggcgtgagccactgcacccagccaacctcttttttttttttgagacgaagtctcgctctgtcgcccaggctggaatgcagtggtgcatctcggctcactgcaagctctgcctcccaggcttatgccattctcctgcctcagcctcccaagtagctgggactacaggcgccagccaccacacccagctaattttttgtatttttagtagagacgtggtttcaccgtgttagccaggatggtctcgatctcctgacctcgtgatctgcctacctcggcctcccaaagtgctgggattacaggtgtgagccaccgtgcccggccctttttttttttttttgacggattcagcagcctcgcctcctgggttcaagagatcctcccgcctcaacctcccaagtagctgggattacaggggtgtgccaccacgcccagctaattattgtatttttagtagagatgggcgtttcaccatgttggccaggctggtcttgaactcctgagctcaagtgatccacccaccttggcctcccaaggtgctgggattatagatgtgagccagcatgcctggctgcttaacctgtttctagggtgccacagacagagctcaactggactaaagctgggcatgaaacccaggccttgggcaagtatttcagcctttctgagcactagtttccttaaccagggagggagctcgtacagctccttctgaggtcaggacaggaggcactcactctgcctgaacactcggcagcccctcgtggtccccatcccagcagcccagggtagggtgtggccttactgtccccttccatgttctgcaccgcggtcaggctgaggctagcggtatccagcttggtggcatcggccttgaagctgaaggtctcattgtacacagggttgatggagcccagcacagctgaagtcttcttgcacttgacaaacttgttgtggttcatcagagacactttgacaaacacacctagggaacagtgagcactagtgggctggcagaggcaggcgggagcagagcccctgcctgtgggaggtccggctaggagggcacgtgcccaagctaggtgccagggccccacccctcacacagtgctgcggccccgcgggcgtgaccagaggaagccggctgaggagtgcactgccctgcggcccaggcggggctccgctcccttccttttccttcctctttgcatcaggaaagtacccatggctcctgcaggccctggtttaccagagcctggcaccacaagcctgtccctccctgttggggggctgctcactgggcccccaggccccctggggccccttaaacaccttgtacagagggctaagatttggtgggtgagggtcagagtcacagtggaaggtctggatcctgcctggcttacggtgaccccagacgtgaacacaaacaggtggctgaccaccaccacctcactgggatgggtgggatgtgtggggtgagcccaaatggggtgggacatgtggggtgaaccaagccctccccctctgcagctcctgtattctgggttctcagaaacatcagagccacattttctcagggggcttccctgtctctccagaacccagctcccagcacccctcaggacagagcctgcccagctctgcccatgtcacttcactgacccccgcccctgccaggcttctcccacacctgcagggccagcacccaacatgctgagagaatggggacccagaaccagatgaacacatcaggggaaaccgaatccattctctcttggggtcctgagcctcccagtgacagaagatccaggagatgcgagtgggaggtcgccctaacaggatctaacatcatgctccagattgctgaagggacacagatcggtgcctcctctccttgactctaccctcctcactccttagcaccaggcctggctgtacatccctgccaaggtgcaactaagaccttcacctgcagctcaggggtgccccagacaggagcacaagaggaggctcatccccacccacaacccaggccggagcgaatctggctgctcaggctctgtgtctggcttctgccccaggacctgagcccatgtaaactcaggcttccttggcctgccctccccaggcccaggttctaaaggtgtgctccccaccacttccttgttgctcctccactttgtccctagaattacagcccagctctaggtgggactgtgaagctctgcccaatgctttccacgagtaatcagattcaggcccttgtgcctgaagactccttgtgaagactagatgacaccttctccaagagcagctaaggaatcaccttggctcctcaggctgagtatacatgttctgtatggaacttcagaaagaaatggtcaacattcattcctcactttaccagagaaagaagaaaatgtcacgtgcctttgattccctctttttaccaagactccactgagataaaactcctaacacagaaaccaacacatattctcaacactgggtacctgctggaggtcctgccttagccccgaagcctcaggtttccatggggacaggttggttgagaactggtggcctagctctcagcctgacacccaatagtatccccacccaggaggcagatggtagtgcaggcacaggttctgcaggctttcatctcatggaacgtatgttagagggtgtcctcgtcactcgccatgccccagaggaatcagcagggacatcaggactgagagaagacatggcacatctgacctcctgtcctggaaaccccacatctttctgactgtgccaatcacacggacaatatctagaaaagttctgctctgcacagtgttctgtctaccaggcccacccatctgaggacccagatgctaggaacacacagatactgaaggagcaaccacctgcctaaggtgcaggtacccctgcatccatctgtgggaggaagagcaagaaactaccatttatatggattctttggccctaagaatgaaccacctatttaggagtaacacagtgatgcagaatgaccagggagggtcattctcaaccatgctccctggtcattctgcatcactacaatacacatagaatccccagaatacacacctattaaagcctcaatattcttgcttcatacaaacatttgcttacagatcctgaacacacacaccgccccccaccccagtggtgtgttgctaactgcttaataaaatgctctccagggggaaataggaaagcctagaattgtgatgcttaagtggtgtaaatatctcagcatgactaattttaaactaccaacctaacgccactgaacacagagatgagaagagatgtgccatgcccagtggctaccccaagccagtacaagccagctccagcacagccacatcctttcataggaatatgtgtacacaatctacctgcaccctgagtaggacccacaactctcaccccaaatataaaaacaaaaccaaacgatgtacctccagaacacaacctcctcatatatcctgaacagacacacacaactgagataggatagggtggccatagcctccattaaaggagaacaaccttgctaaacagatgaagagaacaaaccatccgacagtgcacaaggaggtcctgcagtaaggaggtggaaaagaagaaggggaaatccccaaattcgcacaagtgtgaaaacccatgattagtgtccctgggttgaccagtgctcattataacagtgaaaaacacacccttgggtagagatttaagatgttaatgattcacctgatataggcactagcatgtgcagcatttagcgcatgcacgtccagagaacagtccagagagtgcttaacagtgacaccccttcccaccccttcatgaatagtcatgtaaggctcccataaaggaggtttccccagtgtcagtcaatgctgtctcacctttgagcagcccactctgatcggctgtcagagtgtacattcactttgcagtaacctctcttgcttacttttacgttggactcactctcaaagtaagacttcttttgtgcagcaaagtcaagaacctgaaccagcccaccagcaacacaactgctacctgtaccctaaatacacagatggcctgcaccaattattacttaaatttgcagacaaaactctacctgccccaaatgctcacctcactgctaaaaccatatatgtacatatatacgtgcccaaatacaaacacgtacaatgaacacagtacccatatatacccatatatagtgtgaaccctgaaagggctgatcatgagtggctaactgggcctaaactcaaaatggagccaagcagccatttgctgactgcaagtctcacacatttaccctgtttcctgcaaaaaccacgtacttgtgttactttgggactttcacagctgtctgttcctgtttatgtcacctgaatcaaggggtaccatttcatcatatggacttaagaaatagactgtgacttgcatcagccaatcagaaataaacaagcttgtatccctcatttgcagagtgaaccagatcgggaatctgagaacgaatttctctgtaaaagataatacctctctttgttctttcagagtgtatctttgttttgcactgaaggctgggactccttgatttgcaaacagctcagtggaatcaaatttctatttttttcttttgttattttttaaagaaaatccttttcagtagatttgttaacagtacataatgaaaatcctataggcataggctcaaaaaaaaaaatcacaaggtatacaacacttgtgtcatgcatcacccagaaaaagaatcacatacaatcccacagctctaaaatacaggaatccatgattcttgaatccaaacacaacctacacagcctctctgtttccaaatacatgcactgaacctcccacatctcccagaatacaaaacacagaagccacataaactcaaatacacacagaaccacaaactatttttatcaaatacatataagtccacctcacgaactctgagaacacacatacaagtggcaacaccaaattctgcgagtattacatttcacaacagacacagaggaccactaagtcttaatatacccaaaacccctcatatacacactcacaaactacccatgaatacacacctcaccctcccagataaaacccatacaatacaaaaaaaaaaaaaaaaacccacaaaaacaccaataatactctaatatacgcacacaactttcatatacccatgggcacatacaaactcacacaaatatccccaatccctgagtgtataaatcccccgaaacactatccaatcaatatgctacatctccagaatacaacctcctcacctcatcccctaaacatgcccaaacacatgtacgaacatcctagcattctccaaagaaatacactttaaatactaacaatcccgtattctataaacagacttagataattcatctatctgctgataaatatacacacaaaccagtatacacacccaagatgcacagaaatatctccagcatatcatttataaatacccataaaaacagttcccaatcccaaattatcccaatctagtatgaaccagctcccacattgccaagtactaaccaataaccatatcacatacctctaatacatataaattcaactctcccactctcctgtataaaaagagaacctcatctctctatcagacacacacatactaaattcccagaatatataaccctaataaccacttactgaaaaacacaagcacatagctccacaaaaccttcatctaaactgccacgcccttgaacacacccacagactcaatactcatgtatttgtctacatgccctaaatatacccgcgattaactaacacgccacaaatatgcaaacatgccacctcatatccccaaatacacatacagttccacaatacctgcacatatgtaatcacacttccaaatgctcacacagaaataactcctccatcttccaagacacagaatcatataaactccacctcataactgcacacattcatcctaccagtcccccagtagacatggatctgccctcacacattgaaatagccatacacaccccctgaaaatcatgaaaagaagcacgcatcaccatgcaacatgccccgagtatacaaatggtcttcctacatttcccaaatacgtaaaccaaacagagcgtacatccacaaaatagacacaagcactttctctgttattgcccatgtgcacaagataattcttccaaatctgccaaacattagacaaatacaaatcgccaacattcatctgagaaaacacatggaaaatacatcttcacaacccaaatcacaaatatataaccccaattcttctggtatacatatcttacatctcatattctccaaatataaactctcactcctacacactctcacaaaaacagttatgaccttcttttttagggggcggggaatggagtctcgctctgtcgcccaggctggagtgcagtggcacgatctgggctcattgcaacctccgcctcttgggttcaagtgattcttctgcctcagcctcccgagtagctgggactacagccatgcaccaccacacccagctaatttttgtatttttagtaaagacggggtttcaccatgttggtcaggctggtctcaaactcctgacctcaggtgatccacctgcctcggcctcccaaagtgctgggattataggtgtgagccaccgtgcccggcccagttatgacattctttaatctgcagtctccacacagacaccaccaacccacacatgtgaatacatattagattctcaccaattaaatacatatcaaattccaaactaagaattcatataaacatattttcacatacacaaaaccacccgcacaaatctcacaccctccaaaatccaaaataaatcttcctgacattctcaagtacacactaacccaaccacccaagataacacacgtgtgtgcagtaaattttagatacatgtgtagctacaatttacaaataatataccactactttttatttgtaaatcccacataagtaagcaattctcatggaagcttttcttgactttggccacactcttgcatccacaaccaacttgtgctaccaagtgaacaaactatgactaaaggactgttcttccactttgcagctgctcctatcagtgacaaatcagcgtattagaacatgcatgctggttgatcattctgatcaagtcaacaagcttcacaacttactcaatgaggtcgtccgtgagaacttcactgttttacggggacaggagctacttctttgctgaactgcatcacggtttcaactgctgaggttttcttcaagcttttgcattgtttggaatgtgaaaggcacggccgagacacactttgaggttcccactgcattgttacacctcccccctcacttcagggccaggtgagcaagggaaaggagtgcggcctgggcgtcccgcagggcccccactaggaaagctatgaacgctcccgccttgagcacagccacaggcctgctctggtcacaatgtggggtcgccccgcagacactggtgaccagtgggagcatgaccaggaggtgattaccttctgatcacccttggctttatttttaggtaacaccaagaaggacgccatgagagcgaaggccattgggtaaccaccctttgctctcgcgctgcgcgtctccctgccatcaaccgccactgggagcggttgagggcggccggcctcgcgctggaaccttgcccgcctcaaggctcctgcggcggcgcacggggcaggccaggagcccgccctaggagggccccgctggagatgtggaaatggagggacgcggcacctgggcgcttcctggggccagacaacgccccctcattggaacctccatgaccgtgcctctgagaaaccagcgcgtctgcgacgatcactcctaattttcggtaatacaaacctgcagtccatgcacttaggtaacacccttgctgaaaggtttacctttggagggtttatcctaaagcaaagtatcctcgaattgcatgtcttgcattccctttggatggcattgatttcattcctgctcatgcctttcaaaaaacagtatgccctgttttcctactcagtctggaggttccattaaagagtatttctggcaaagatttttagacctgaaaacacactccaaaatatactttcttctgactccattcccagagtttttcctaccgcattcaaatgatttctagaaatgtttttgttgtagccttgatcaatttcagtcgataaagcagcagatagtaagggaacaattccacgctccccacccctgactctgcaacacagtgcagaattccagttggcaataaaaaactagtagagaaggaactcactgacttcagtttgtaataccgtcagaagaaactttaatcgtcacatcctttctgctcatttgcaggattcctatcatctgtctccacgtgataacactgaagagccttcacgttgatgcaggcccagggcctcaagtgcagagactgagagctctgcaggacacagcatggagccgccattcctctatgggtggaagagcatgtgtcctctgaacaggggatccaagcactgagatattctttctcagctgtcagtgcggcccaggactttctgtggggatgctcagacagcaggggccggaggacttttagccaacacctaaaatggtcagtcttcacaaattacctttggctaatttgactgtctctcctcctggggtctaggacttcaaacatgtacagaagcgattgcagaattaagacaagacacttccacaatatattttttgtatcactggctcagaaaaagactcattcaaatcctgtatcaaagccacgtgtgagaatcttgagaaagcatcagctgactgacttgacaagggaggaagcaaccaaaaattctgcgcttcttcagtatctgagtatgatattttgcttcaacatccctcttagatgaagttattgattgaaaatcatttaagtttgccccatggtaaaagatcaagtcctcagaaagatctccaaagtgtttacggtttgttttgttttggtaagtttaccatgattttgcttgaattgctctccgttgatcttctcagctaagatggaggtagagttgcacagtagaagagggctgcatgtaagaaggcagttctgtctcagaggacaaaaggcctgggagcacccagacagacagtcactgcatggaggtcactcccctcccagtggccactgtggagacatttcacagaaatgcttgctggaccattcaggttcagagttgggacaaaaccgagaactcatggggatattggacaggagttaggaaatgaccttctcacacaactggggcagtgggggagaaccctgggcttgagacttgcaatccaccacttgcccctgcccctgcccctgcagtgtggccgctgttaccttttcctgcaactctgccttcttgagtccaaatgtcttcgaaaggggcaaatgcttcgtaagtgccgacagggtgtgtttcagtgaatgtttgcagtgtgcaccggtctggctgaaggcctcttcccttccccaacaccctcccatcgtgcaaaattaccctgcccagcagggagtgacttgtgtgtctcagaagattttgttgctgtgctctgagttctcactcctcatctcctttgaccagtttcttctaatactccccttgttcacaacacagaacatgagtgctctttcctatcattttgacactaataaacggacagtgattctcagtgtggaaatgagaatgaagttttttttaaagacaggctacaataattcccatgcagagaaccacatgcgatgacactggattccaaacagcaagaacgtatggtgaagatgaggccaacagtgagctgagagaggccagccagggtgtgtttcagtgaagatgagaaacaatcagataacacctgtttcctccaggaaagaaaatgtggccagggaaaagagatgggaggaaggctggtcattgcctattccactgtgcacagtttgaatttggagccatgaaaagtattgcttggttaaattaaaatcattcaaaagataaaacataaacatttaacaccagcacaatatgctgggaaacaaaatgaaaggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccaaagcccttcacagaatgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttctcattgcggaaactgccagacagcggtggtcagtgcccagcctgaggggatggcttcaaatggaggtaagcctgtagggatgggggcattatctgagtctgccatgcctcaactccttaggaattcaaatttgacactgccccggggacagttgatagggctgatgttgaggagggagggaagactggatgtccccaaggacatcacacctggggatggccatggcaccctgagtctgtgtttagggaggacggccccttagaggtggaacaagatgcctgggggaatacaccgtgtaggagaaaggacagagtggatggattgatcctttctagaaggagacaggtcacgtcattgtgtgtttgtagggagtggtgggatcatgttgtgctggtggccccgggaggatgataggcaagcctgaaccctgtgccatatcttcaggcacctggaaggtgcccttccatagtgttcagagagatttggactggagttttctagatcttagggaggagtggggagaagtggtctcagccagaaaactgttgggtgggttggctgtgacagagcatgtagtgacagcccctgggtgggcgaggctgggggctgctgtaactgccacagcccagagcccctcagctctctccctagagatggcttctccatcagttcaggtagctgttggctttgatttaacaggggtgggggcagatgaggaagttcaggcaacacagggcctgggtttcctgagttgttctgaattgtttgcccttttgtggaagctcaggtcttcagacccacttcctcttgtctgctagctcatggcctgtcctctgcactttgtgttactgtggagatgaagaatttgctcctattccatttatactacctcatgaacggggggcaggtgtggattcttgctggttctcagtggaagggtctggaaaggctggtttccttttcagtagaggaaggagagtagcgcacgaataggaagatggttctcttattattattattcaagttaggatacgtgtcctgaatgatgaggtgcatgtgctgtatcccttattccccttgactagagactgcatgaggtcctattgaacagggatgagttccagacaactttgcctcacccggcccatggcccaagaacccctggtttttggttggtcactatgttcagtcattgggagctcaaaggagaagggccagggatgggctccttgtcccactacctattgtaacatgaccagcagctgtgaaaatccctagacacctcccctgttagctctgctgctcgccatttgctggctgtgttctaatcgtgtgtggcttttgctggctatgcagtgacactgtctcaggggactccaccactgcctctcagacctgctccctgggaacagagcttcctgagtggcagccgggaccatcgagtactgcggaaagggtggcccgaatctgacccctatttagcacttgctgtgggtggtgccaggacaatcacttgcatgctgggcatgacgagttatggattatcttcagggttcctagggcgctggcttgggaaagatttccatccagtggttttgttttgttatgtctgagctgggaaagaaaggggtttacaagagcgtcaggaaaaggaagattgaagaggagatggggccataatattcggaagcttctggcttcctgtcggccttctgagtgccgagcactgccctggggtaggcccctcacctgttgctgagcacgctgaggaccaccaagccgctgagagactcatccctgacccatggcttgggagatgcctgtgaggctgacagggtctgccagggacacccgagggagaccctcgggcagcgaaggcttggctgttacttcttgggagacaggggtcagggagtcttggtgaccggggccaggctctctagtggagcgactctccgtggaggaacagagcatccgatgcacactcagggacatttgcaagctgcagtttccctgtcatacgcccttagctgttgggactcccctctgattccccagtgactagtgtggacctggagaccccagctcattcacctctttcctttgtctccacagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatgtgagtgtcctcggggcattggagctggtcctgcagctcacacgtaaagaggctgctggatggacgggaggtcacgctgttcaggggagcttgcagggcggttgtgagggtgatgggctgcactatgggaaggtatatttttgaccatattaatctggctgcggctcaggacagactgtcaggggcctcatctcaactgcccgtcactgtcccgtgagtccagccaatccttactttcaataattttcacaacaatgtttacagaagacccaggtcagagagggttcctggtgtgacgtgagctacggtttgggtttaggtctttgagtacacgccccagtgcctcccctttaacccagtattgatggccaggagcacctcacatggggccggggggaggagctgcaggacccagcaggaacctgacacatgcccgcagttccgctgaggtccagttagcacagcggtggtggagcctgcacagggggatggtcttgggccctgcactggggccgatgccgagcaggtatttgcatcttcaccctcaatccctcctagaaaaagggacaatgatgcttcattcagaggatggtgaagagataacttgagctcacatatgacatgcatagcacagtgcctggcacatgctatgacacattacatgacagcagttatgattactgtccccattactatcattatcaagactaggccatctaggagagcactccccaaagccacgggctccagtgatagctctgagtgcaccatgagtccagcagcccagggccatggactgtggtgactgtgaggcagcaacgtcagcatctgggagagtttgtggtttcattcccagtccctgcctctctccaccctgcggtgcctctgtgaccctgtgtttcccgctgatgagcaaacgggagcttgagcacatccaccgtgcaacacactggccgttcccctagggaagtcccctgcctggggtgtaggtggaaggtggccccattttcatcccccaaaatctcgctgttcccgcaccctggaactggttgcattcctccttggagcggagtcccggtgcactggggaccctgattcttggggtggagctgccccaggctcacaggcctttgccatggctcctgtgggaatgtgggatctggacctgctgcttgcagtggcgtggacaccgctctgctttggttctggacgtgtgctcctgctcctcatgctccagggccctgaggctacgtccccaggggctgccttgctccagagtccccaggaagccggttaaatgctcagtcttggggccctggaacctgcactttaaccctcacccccaggtcattctgtgtgcacgctgtctcagtcagctcaggctctgccgtaacgaatgccgtagactgggtgctttatcaagacacattcatgtctcccagttccagaggccagaagtcccagatcaaggtgacagcagatcgggtgtctggtcagggccctcctcctggctggagagagctgtctctggctatgtctcctcgtggctgagagcaagagccctggcgtctccttctgcccttatcagggcttggattccatgactgggacccacgctcatgacctgctttaaccctgattgcctccaaatactgacacattggtgctgaggacttcagcacaggaatgttggagacacacatgttccacccatagtactgagtccacttctcaacactgaggactcgaggggcagtcggagaggccacttggtagcttgtgttgatgtttgatcttgggggtgtgtcctggggcctgaggagcccacatgggggagaacaggacagggacagatggcaggacaggtgtggggaggacaggggccaggtgttgggaccaggtgggcttgggatgaagggtgggcttatagactgagactgactgcactggtttacagcccagttctccgatccctggcccggcggaagcccaccatgaccctggaggagggactgtggcgggccatgcgggaatggcagcacacgagcaactttgaccggatgatcttctacgagatggcggaaaagtgagtctggggtcctgggagcggggcccgcgtggcagggtgagagtgaatgacagaggcccggtggccatggtggcttctcaacgtggagtatgaggagggtgtggagaaacccaggacactctgggcccctggctccctcaggaagctgctcctgccacctagagtgttctggggtctctgtcctggcctattgggaagcaccccctgcctggcctggggccatccctgccttgacactggaggtcatggcaggagcagccagcatcacagaccaaagtgggtcacctccagctgtggggatggggagaaggggcgctagtgactatggacaagagtagggtgcaggctcctcacagcagtggccagaagtcggttttctcccatcccagcctggccagggagttgggttggggagacctgcacctgggacaccatgggacccatctctggcctgactgcctttgctcctgggcagtcccctccatgaaggcagacagatagacagcagcctcaggggaaaggggccctgtcctctgagctcagcttttgcttcctcctgaccaggggtctcccaggcctcgtgcccctgggttatctttcaggggcccacagtcctagcctcaggactcctgcatctgggcatcatccctgatgccttctgccataaatcccacccctggccagctgaaacctggaggaggggtcccccgagaccctcctggacctcgtggccctgagttgagtcaggaagccccgttgatgccatgggctctgcaggggccgggtgagggagggtgagcccagaactctgggagcagctttctcctgggactgggggatgggacacagtgagggcctggacagcccacccgaggcactccctcccatccctgccctcggccgctgcctggtcctggggggagggggcctggaccctctcagcacagcctgggcctccttcaccgccaggttcctggagtttgaggctgaggaggagatgcagattcagaaatcgcaatggatgaaggggccccagtgcctgcctcctccagccacaccgaggcttgaacctcgaggacccccggcccctgaggtggtcaagcagccaggtatggcttcccacattcccacaggagccatggcaaaggccaaaggggccaagggaggccactgtccccacaccccatgcttcccttcgagagggggatttgctccctccaacaggacagtttccaggagcatatgttcggtattgacctggtcaagtttcctagctactctctcccctcgcctgtccaaaactccacatatgctctgcccaggaagcagggatgagcggggagagtacacggcatattggtggctccaaacttcctcccaagcgatgctgtctcagatgtgcccctcctgcctcctccgggggcgctgcggttcaggtggtcctgacccagctgggacccacttcacatccccaagccctgccctcccctgtgtggtgccagcaggaggagcggccctcaccacgcccgtcctcctccctctctgcctcagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtgggctggcctggagtgctggggtctgctggattccagggggtggcactcccaggtccttggaattaagctctgttccttagctactcagcagtgtgtgtatttccatggatttgagtatctgtgtatgtgattgtgtgtgtgtctgtgtgttgctgtgtgtttgtgtctgtggtttgttactgtgtgtctttgtgtgtctgtgtgggtgtgagtgtggagtgtgtacgttacctgtgtctgtgtcttttcctgtgtcatatgtgggtctgtttgtgtgtctgtgtgtggtttgtgtgtctctgtctgtgtgtgtgtagctaccaggtctgtggtctgtgtctgtagctggtggtcaccatgatatgagacagccccaggagggtggggacggggcgctcgctgctttctgcatctcctccaggtgtccttggctccaggttactccctgcccaggaagctcacgccttcttccttctgtttccaggtggaggccgtcattcatccccaattcctggaagaattgctttccccagatccacagatggatttcttggccctaagccaggagctggagcaggaggaaggactcacccttgcccaggtaccccaggggcaggagggacctggcacacaaggcccacctgattgtctaatcccccctgctggggatgctcggcttcttggggagccactctggagtgggaagatgcaggttcagagggagtaggatggacaggagccagggaggggagtcagcatgcaagctgtggtgaggcccaacgggaggcccggcagagccacaccctctctctttgacataaagcccagctgcctcaggcttccctacctgccgcctaagtgccctggtctccaccaccctgggccccgctcacacctggggcagtgcccgtaagtgccccctttcctcccgcagctagtggagaagcgcctcctacccttgaaggagaaacagcatgcgagggcagcccctagtcgtggcacagcccggttggactcaagttcttctaagtttgcagctggccaaggagcagagagagacgtccctgtcccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagttcccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttggaaaatgctcttggggctgctgcctctgtcctcggtgctgtgctgctctgtggagggtgtctgtgagggagggcagaggaaccggcagatgccaggctctgggaacccacaggggccggccccactctttcctcctgacgtagggagccccttcagatgctccagggactgacagatgctgaggaagccctgatccctcccaccacccactcacaaggccctgcctgctttagggaggcttcttggggcccccccatcgttatcagcatccctggaaaatcctgggattggagagagctggctggctcttgttctgctcggtgggagctgaggagaaggcagccgcctgcaacatggacatggggagaggaggctgctcctgcttaaccctcatcaggaagagcgcgggcactgggctgaggggagacgttgaggtgaccatccacacaggtgtgtttgggatacgatgatgggtggggagcaggggaagtccttctgcctgtttctgggcaggagagagtcttgtccaactagctaaagcagatgctccttgctgtggccacagggactggcctcggggccctcaaggtcctgcatggagccccccacagctatgattcccttcccatatgatgactgaactcatgtggaattgatgtagacacagatttacattggtttctaaaacagttccctcccaacacaccatcaccaatgggaacaagcatgtccagtccatcaggcgcagggtgggtgtttctgctggttccagggcccggaggagctggggcccaggccaagaggggccgagggtctgccgcccttctgccaggcacagaccccaagggcagagcaggggctgcctgggatgtggcattggctgtctgggaagtgccctgggagttgggggctaggtgttcgccaaagagagacttccagagtctatgagtgagatgaggactgcatcaggagagggaccgaggctggggaggatgctctgctctttcccaggttgtcctgtcttcccaatctctgctgaactgccctcaccccatgggccaactctgccccccttacccctaacccacctcttagaatctcagatcccagcgtggacaggacccggcacccaccctggttccctcctggccaacaccttcttctccacggtctgagttctgattcctcccccagggcgcttattggctcaggacccctgtgactgccagggcactggtcccagcactgcctgcgtgcagagctgtggtcacggccctgggggctggcccagcagcagaggctggtggggcaaagctgtctggtacacggtggcctggcccctcggccaagtgacaaagggagccatgtttgggtcctctctggccccatctgcccacagaacacagcagtcagcctgacagatgcccctctgccccgtcccttctgctcgatgtgggcagtgtcggaggcctgctgtcttctgtggcctttgggaaggagagtttatcttggcagggcttccccagctcagtgcacgtcaggccctcggggaaaatgtggggagcgaagagtcactggtgggtgatgtgggcagctcccgtgactcctctacattcacggccatcctcaggagataaggtagcactgcccctttgcagggtttaggaatgttaagtgagccgtgtttgaagggaacatggtccatactctggcgtgtgtgggtgcccagccaacttcctcacctaagggtgaaagtgacaccttggggctcctactggttaccccactggctgttgtctatcctactgtccctgtccttgtcttggctgagccattcctaggaagcagaacttgtgcttcctccacctctgtgtcccacctgagccctacaatctgcccctaaatgggcacagtggggctgactggggggctctggtagactgaacatacgtcccccgcccagttcctgtgctgaagccctaacccccaacgtgatggtatttggaaatggggcctttgggagttattcagggttagaagagaccatgagggtggggccctaatgatgggattagggccctggtaagaagcagagaccccagagctctctctctccctgacacaaggacacagtgagaaggcggccatctgcaagccagagagagagccctcaccagaaccttgcccactgggatgctaacctcggacttccagcctccagactgtgacaaatacatttctttttttaatatgtgccaccacccccaagtctatggcactttgtcctagcagccctatgtgactaggacaaagtccataatctcaagaacttccttcatgactggtatctggaaaccgtgcatcagagccacgggaaagaaaggctcagccctttacaactgtcagcacacctccaccccaagtgcagtgtatcacacgtgaaccaggagagcctgggacgcagtgagttgtgcttcagttaatgtagagaacttcactgaaccgcacataaccattgaagtaacctgctgtttacagtctccatcatgttctgccaagagagttattttacagtgacaaaacttctcttctggtgccctgacacatcctaggactttgatgctggtaattctttccccccagcaaattttggttctaaatccacagaactacttgagaaactagatgcaaaattgtagtaggtttaaaatatcaatactctttttttttttttttttttttttttaggcagagtctctcgctctgtcacccaggctggagtgcagtggcgcgatctcggctcactgcaagctccacctcccggattcacgccattttcctgtctcagcctcccgagtagctgggactacaggcgcccaccaccacgcccggataattttttgtattttttagtagagacggggtttcaccgtgttagccatgatggtctcgatctcctgacctcttgatccgcccgcctgggcctcccaaagtgctgggattacaggcgtgagccaccgcacccggcctatcaatattctttatatgttttgctattcccatttaaaagagggaaactgtagctatacactttctagtcatgttctttggtgattttcctgcacaaaccaacattgttcttcagaaatataatttcccctagaattaccctccatccaaaacatattgttattctatcacagagataaataatggctttccaaatcctggttaaaaaaaccaaacactctcttcttctctgtatttttccagaacaggcatagatgatggcaattgtgttttaccatctttttttttttctgagatgttagttttctaggatatggaaatcttaggattcataaaaaatgaaacaactttttgaaatgttagttttccaaaattggacaatctttttgagccattctatttttaggactattcgttagctgactttagagcctttaatgtttcgttattatttcaaacaatagagaactttactcccccccaaattttgagacagggtctggctctgtcatgcaggaggctgtctgtagtgcagcggcacagtctcagctcactgcaacctccgcctcttgggctcaagtgatccttccacctcagcctcctgagtagctgggactgtaggtgcaggccaccacatctggctaattttaaacaatagagaacttccaaaacaaaagttctttattaattcttcaagaaatctgttttttacttagtcgattaatgtccatctcatgttgcctcaatagcccatgtatgaatcactcttcttgcagattttgttcagttttgttgtatgtagacccatctttctttgagttggtttctttgattgagttgatttgtctgtattaaaacccaaacaatacctaagccaaaaaagcaatgtaggcacctgtgaactcacacacttggttgcaattgcttcagtaaaaaggacagtttacactcaaattgaagcaaccattatgtttccacaaacaacattccttattatcccacctcaccttttcattcttcctatgctgtctaatctgattctgtacaagagataaggcaggtactgctaaatgataacttagatgcaggggccatcatgaaaatattcatcccatatcttacattaagcaaactactagcaactgtttgttaaaaagtataaatgaataaatgaaaataggacagataggcagtgtgggaagctaaaatatggaagtgttattgctttgctttatgtggtataatgatctgattttatcttcccagctctcccaggaagtatgcagaataatatttatctcatattgtgggtgtggcaatcaagacagagaggctagatgctttacctaaagtcatccaacaaatatttggtagaaccagtgctagaatgcaataaatggaaacagagtttatttcggtgtttcttttcctgatacttgccctattcctgacaaatgaataatggcttcagaaggtgtcacttgttgctagggctaaaaggataaattttacctgtaataccgtaccacttactattagttaacgacccagtatttattctctttttttctttggaatctttggaatgtgtaaatatttgcctcccgggaagctcactttatcctctcctcaggaaaaaatcctgatttggtctgaaccaatcttggtaactatctttcttgccagttttgttttaggaatgggcacgcaactcagttctagccaacgagatatgaggagcagtctactggggagtttctgggaaagtttgtttttcttgtcctaataaacaaacaaataatggggtcactggattggagatcctattgagtcaaaggaatattgaatttgacacagtagaatagtctggaaggaaaggaaatgatattcagtaaatgaaatgctgaaaattgatattatgaaggtggcgcagtagttgttattgattaaatgaaacagttgagattaagaaagtttagccaggacaagttatatagcacaaatcatttcaggtaaggaagttaaaaaaaaaccctgagaggctaggaagtcctggctccaaactcctgctcctgctggacttgagccccactagcttctcatcttccactaatctatgcacccctcctttcccactcctcaaaagccgagctcactcaacaactttaattttattcaaataaattatttacacagacattttgtttttagtagatgttattagtgattaggaaaaatgaaagagattgacatctttcaattgacagagatgccaataattttaagtataattttttaaacactttgttcttaaaatgagaaagaaatgtaaggaagggatcactagcctgggcgttagcatgtccgaatatgataactaaacctgctgcaattatcttgcaaccagggaggagctagcttgaaaataaagccaacacagatgacaagcagaaagtggaaagaacctaagtcgttgatgatgctattgagctgatgaattaaacctggagtgtatgttccatgggcttctgtaaggaattaaaatatttttactgtttaaaccagtgtttcattgttttctgcagaaatcctaattggcataaagaaactattgaccgactaaccccactgcaacctcacctgaccccttaggatgtcctttcatgattttcttgattttgttgaagttacgtattgagaataatggaaaatcacagaaggtgattttctgatcccaactccttagctatgaccttgtgtctctagctcatgatcatggtttatgaagcacgggaaggactgggaaaagtagaaagtaggtaggtaagatgagatgtctgatgatggaggttattggggtcaggacaggtggataggcaagttgaagtgtgtaagctaagcaggaaatgcaaatgaaaatcagagagaaggtaccccttcagaacagattcttagaaagccattattagaaacatatgggccacatctttgagaaaagttgtggaattcacattacagtaatggcatcacttagattcatgctcttctctcagggagagaaatcaatatttataggatatcaaagggtcttcatcatgtgtctcagtctgtttttattgctataaacaaatacctgaggctgggtaatatataaggaaaagaggtttatttggctcacacaattctgcaggctgtacgagaagcatggcaccagcatctgcttctgttgagggcctcaggaagcctccatcgtggtggaaggcaaaggggaacccgtgtgtcacatgatcagggaggaagagagcaagagaggggaggaaggtatcagattctttttaacaataagatctcacaggaagtaggagtgagaacataatcccatgaagacagcaccaagccattcatgagggatctgcccccgtaaccaaaacacctcccagtgcgccccacctccaacattggggatcaaatgtcagcatgagatttggaggagacaaacattcaaactttatcattgtgcttgttttcttcagaaatagaccgaattgatatgtttcatgatgacattatgatctaaaaatgagagtttatttcagtttgtcctgtatacacccaagaggtccaggatattattctgtctgtctaccacaagtcctgcaaactagaagatggccttaacagtcaatctagggtggttctgcccaatgaccttttgtctttcctcagtgtcttccaaagcacatagtaatattctatcatgaattatatgaaagctgtttacatggattaaacagtaaatctgacaaacaggctgctttttgatgactctagacatatttcttcttacattttagacatttgagaaaaaaagtcaaatttcttaatactttatgttcaattgagtttgaagccataaagaggaaggaaataataaggattagagcaaaaataaatgaaatagagaatagaaaaacaatagaatcaatgaaacaaaaaattagttctttgaagagatcaacaaagttgacaaagctttaactagattaaggaaaaagaatactcaactactaaaatcagaaatgaaagacactactactgatttataggaataaaaaggattgtaagagaattcgtataagagctatatgtcaaaaaattggataacctagatgaaacagacaaattcctagaaacatacaaaccaacaaagttgactcaagaacaaagaataaatctgaatagatctataaaaagtaatgatattcaattctgattgaatcagcaaccaaaactctcctaacaaagaaaagcccaggaactgatgacttcgctggtgaattctaccaaacgtttagaaatgaattaacactaatccttctcgaactcctccaaaaagttgagaaacagaaccctttctgagtcattctatgaagccaacattaccctgataccaaagctagacagacaatacaagaaaactatagccaaatgtcccctatgaatgcattatagatacaaaaatccccaacaaaatactaggaaattaaattcagcagcccttaaaagaattttacactatgaccaactgagatttatcccagaaatttaagagtggtttaacgtatgaaaatcagtcgatgtaatacaccaagtaatagaatgaaggagtgaaaaactcatgatcatctcaattgatatagaagaacatttgagaaaatccattcctcctttatgatagaactgttcaacaaaccaggaatagaaaggaactgtctcaacatgataaagaccatgtattaaaaactcacgactgacatcattctcaatggggaaaaatttcaagcttttccactaaaatcagaagccatggatgcctgtgtttgccacttctattcaacatagtattggcagttctagccagacccatcaggcaagaaaaagaaataaaataaatccaaattagaaaggaagaagtaaaactatctctatttgcaagtgatataagtgtagaaagccctaaagaataccaaaaatagcctcttaaagctaataaacaaatttagcaaggctgcagaatacaaaatcaacacacaaaaatcagtcgtgtttctacacactagcagtacaaaatctgaaaaggaaattaagaattttttatttacagtagtacccaaaagaataaaatatttagaaatcaatttaaccaggaaggcagaagacttgtacactgaaaactacaaagcattctggaaagaaattaaagtagacttaaataaatggaaagagatcctgtgttcataagttggaagacttaatattgttaaaatgacaacgctactcaaaatgatatgtagagtcaatgtaatcacgctaataaaatcccaacagcgcttttggcagaaatggaaaaacctattctaaaattcatataaaatttcaaggaacccaaaatagccaaaataatctgaagaggaacaaagttgtaggactcacattttctgatattaaaatttactacatagctataataattgaaatagcatggacttggcacagaggtagacaatatagaccaatggaatagaatcgagaggccagaactaacactcacatctatgggtaattaattttcagcaagggttccaggatcactcaatggggaaaaggacaatctcttcaacaaatggtgttggggaaactagatatccacaagcaaaagaatgaagttggacctatacttttacacaatgtacaaacattaactgaaaatggatcaaagaccaaaatttaatgctataaaacacttaaatattaaatgctataaaactcttagaggaaaacatactgaaaaatcttcatgaccttgggtttgacaacggtttcttaaatataacatcaaaagtacaagtgatgaaacaactgataaattggacttcatcaaaattgtgtatcaagtgacactataaagaaagtgaaaagataacacaaaaaattggagaaaatgtttgcaaatcatacatctgacaaaaaactaatatactcaggcatttctttatggcaatgcaagaatggcctaatacaatacccaaaagaattgaatgcataaagaatcctacaactcaacaaataaaagataaataactcaattttttaatggacaaaatacttagacacttctctaaaaaaaagacatgtaaatggtcaataagcaactcaaaagatgctaaaaccacaatgagataccactttgtacctactagaatggctataattagaagaaaaaataactagtgttgttgaacatgtggagaaattggaaacctagtatactgctggtgggaatgtaaatggtttaactgctgaggaagatagtttggcaattcctcaaaacgtaaaacagaattatcacccagtaattctactcttaagtatataccggatatagtttgactgtttgttcctatgcaaatctcatgttgaaatgtaattaatctccggtgttagagttggggcctggtgggaggtgattggatcatgggagtggtttctcatgagtggcttcaccatctctagctgtcatcaagattgtgagttctcacaagatttgattgtttaaaagtgtgcagcacctccccacttcctctcttgctctggcttttgccacgtgacatacctgcacccactttgccttccatcatgattggaagcttcctgaagcctccctggaagcagatgctgctatgcttcctgtacagactgcagaaatgtgagccaactaaacccttttttctttggcacttacccagtctcaggtatttctttatatcaatgcaagaatggcctaatacaatacccaaaagaattgaaaacaacaacttaaacagtgacttgtacactaatgttcatagcagcattattcacaatagacaaaaggtagaaacaaccaaaatgtctatcaaaagataaacggataggccaggcacgatggctcacgcctgtaatcccagtactttgtgaggccaaggtgggcggatcacctgagttcaggagttcgagactagcttggccaacatggtaaaaccctgtctttaaaaaacaaacaaacaaaaagataaatggataaacaagatgcagtatatacatacaattattattcagccatagaaaagaagaatggaatactgatacatgctataagatggatgaaccttgaaaacattatgctaagttaaataagctagacacaaaaggatagtgtatgataccattatgtgaaatatttacaataggcaaattcatagagacaggaggtagattagaggttaccagaggttaccaggggctggaaggagaggaaaatgggagtttttgctgaataagcacagtttctatttggggtgatgaaagggctttggtaatagatggtggtaacggttgcacaacattgtaaatataattaataccaccaaattgtacagttaaaaatgattaaaatggcaaattgcatatgtctttctccgtttgtgttgctataaaggaatacccaaggctgggtaatttataaagaaaagaggtgtatttagcttatgattctgcagattgtacaagaagcatggcactggcatccacatctggtgagggcctcaggctgcttccgctcatgtcagaaagggaaggcaagccaatgtgtgtggagatcacatggtgagagaggaaacaagaaagaggggggtagtgctaggctcttttaacaactagctcttggccaggtgaggtggctcatgcttgtaatctcaacaccttgggaggctgaggtgggagaatctcttcagcccaagagttcaagaccagcctaaaaaaaaaaaaaaatcccataaaacctagctctcacaggaactaagagaccaaaaactcactcacctgcaacccagggagaatattaatctattcatgagggatctgccccatgagccaaataccttccattaggccccacctccaacactgggtatccaatttcaacatcagatttggagggtcaaatacctgggctacatacccttgtctctagaaaaaatatataaaatttagctgggtgtggtgacacatacctgtagtctcagctactttggaggctgaggcaggcggatcatttcggcccagaatttcgaggctacagtgagctataatcaggccactgtacaacagcctgcaagacagaatgagaccctgtctttaaaaaaataaaaataaaaataaattaattacttttaaaaagaccttgtattgcaagttggtaaacataagtacatttgttgggactatgaaattattcacccacaggatcaatgttacaaattggtatttgcatctcaatttagtttgttcaacccagaattcacatttgccataaaactgtagtcaataattcaattaaactactgataaccaaaggggaaagcaacatattgaatcaaaaatagttttatcaactggtgtcaccaaagaaaagcaggtttcactagtgttgagaaaatagaaagttttctattgattatggagaaatttcagttcagtttctagaaggttaaatgccccaattttttttttaatgactgggttaaactaaataatggcctccattatttccatatgcaaatcctcagaacctatcactgttacgttatatggcaaaagagaatttgcaaatgtgattaagtcaaggatcttgaaattgggagattatcctgggttatctgatgtccccaatgtaatcacaaggatctttataaaaaaggaaatgtgagacaaagggagagaaggtgatgtgatgaagtagaggtcagagtgatgcgggggctagatccaaggaatgtgggcagcctctagaagctgagacagacagggaaatggattctcctcctagagcctccagaaggaaagcagccttgccaacccatttgaaacttctgatctccagatctatacaacaatacatctgtgttgtttttttttatttttatttttttagggacaggtcttgctctgttgctcaggctagagtgcagtggcatggtctgggctcactacagcctcaacctcccaggctcaaatgatcctcctgcctcagcctcctgagtaggtggagctacagacatgtgccaccacacctggctaattttattttttattttttgtagagatggggtctcactatgttgcccaccctggtctccaactcctgggctcaagcaatcctcctgcctcagcctcccaaagtgctgggcttataagtgtgagagtcacagttcctggcccatctgtgttattttaatgtttaagtttgtcataatctgttacagcagcaataaaaaactaacaaaatgactaattttacttccaaacccattgtctccctcccttaaaataattttatcacaatagctatttttatattacagtcacacaccacataatgaccttttggtcaatgacaaacttcatatacagtggtagttccttaagattacagtggagctgaaaaatttttattgcccagatatgtcagagctgatcattgtacaacacattacttacatatttgtgatgatgctggtgtaaacgaacctactgtgctgccagtcctataaaagtatagtacatacaatatgtacagtacatggtacttgataatgataataaacgactgcgttatgggtttatgtacttgctatattatacttgtcttattattttagagtgtcttttttatacttaaaaaaaagttaactgcaaaacagtccttcaggaggtgttccagataaggcatagttaccataggagatggcagctccatgcatgttactgctcctgaagaccttccaatgggagaagatagggaagtgaaagacagtgatattgaagaccctggccctgtgtaggcctagtctcatgtgtaatgtgtgtttatgtctttttgttttttgttgtttttttgagactaggtctcactatgttggcccacgctggagtgcagtggctgttcacaggtgcaatcatattgcactgcagccttgaactcctggccttggacaatcctcccacctcagacttctgagtagctgggattataggcttgcaccatagcacctggctatgtcttcatttttaaacaaaaaagtttgaaagtaaaaaataaataaataaaaatttttaaatagaagaaagcttataggctgtgtgcagtggctcatacctgtaatcccagcaattagggaggctgaggcaggcagatcacttgaggctaggagtttgagaccagtctggcccacatggtgaaactctgtctctattaaaaatgcaaaaattagccaggcatggtggcacactcctgtgtcctaagctgctcgagaggctgaggcatgagaactgcttgaacttgggaggcggaggttgcagtgagccaagatcatgccactgcactccagcctggacaacatagtgagactctgtcttaaaaaaaaaaacaaaagaaaagaaaatgaaaaagaaaaaacctcactgtagcctccacctcctgggctcaagcaatccttgcacctcagcctcctaagtagctgggaccacaggcacacaccaccacacccagctaatttttttttttttttttttttttttttttggtacagacagggtttcatcatgttgcccaggctggtcttgaactcctgggctcaagagatcctcctgcctctgcctcccaaagtgctgggattacaggcatgagccactgtgcctggcctaagtgtaccactttatatcttctatagtttacttttactgtaccttttctacatttaggtacacaaatattgaccattatgttacaactgcttacagtattcagtacaataataggctgtccaggtttgcagcctaggaacaatagacaatgccatatatagcctagatgtgttgtagactataccatctctgtttgtgtaagtgcacagtatgatgtttgcacaacgatggaatcacctcatgatgaatttttcagactatatccttgttaagtaatgcatgaccttaatcaggaatgagtcacagcaatactgtaatcttgatgaagatgttgatgtagataatactcccatttacaatgcacttgccaaatacaaggcattgcactgaaagctttacagactttattttaaaaaattttacaaccttttaggtaagtaccattaaccacttttacagatcagaaaacagggtctatgaggtgaaataatttgtcatacagtggtgatgtaaatatgcatataatgaaacagaataggcaagtcagaagtgatttttgtatttcttttaatagattaagggtacttactatcagcaaaagagtgaaagtctgacagaaaagaaaaagatggaaagaaatgtggggatgtgcaattccttatgttggttggttcagcagagctttgccattgttcagatggagtttaggcaagcaaaagacgaccagccattgctgggtatttgaacatcagatgttcataaggcttaggtattcttaaaagaaaaatttattctcttaaaaattctgaaaaaaagttctctgtattaaaacttcataatgaacattgccacattgtatattaggcacagatattatttgttggagtttttggtaattgttatttttgtaactggaatatttaatatatgttttatatatatttattttatttatttattttttgagatggagtctcactctgtcgcccaggctgcagtgaagtggcacgatcttggctcactgcaacctttgcctcccaggttcaagtgattctcctgcctcagccgcccgagtagctgggactacaggcacgtgccaccacgcccagctaattttttgtatttttagtagagacggggtttcactgtgttagccaggatggcttcgatctcctgacctcgtgatccacccaccttggcctcccaaagtgttgggattacaggcgtaagccaccgctatatattttgcaaacaatagcaaatctagaggaaattctttgaagtaagaagcagtggtacttaaaactggctacttgtatttatcatctctgtttcagttttttaagaaattcaaaatttttacagagagttgataaaaacatttgatgatttggggtgcagatgaaggatggctggtatttgaaaaataaataaataaaggccttccttgattcttaatgttgagactgaaggcttcattggagtttcttcctcagcctgaattccagtgataatgtgtctgttcttgacatgagcaataactggagtacttaggattaaacaaaatattagatgtgccgggccagaggaggtgaggaaagtctaaagtgataaggtgctagtcagctcagagtggctgttttagatagtgtaatacagcagactagaaacttgtcggaaaggaaaggtaccaggcaggagataaatgtacacccaccttagctaatgtaaggagctgaaaactctattttgaatttttatcctaaacatggaaataacatccttatgagaaattgaacactaaatagacatattaaaccaattttgcttattgagacatctgttcattcatttattcaacagctatttactgagtggatacttggtagtttttaggccttagaattaacccaagacaaacttgtgaggtaggaagttgcatctcagtcatctcactactttgctctttcttgagacttcagccttccctttcctccctcaggttttggagcttagaaattaataatattaaagcttcaatgacaagactgtttaaaataaaaaatggttgggctgggcacggtggctcatgcctgtaatcccagcactttgggaggctgaggcgcacagatcacaaggtcaggagatcgagaccatcctggctaacacggtgaaactccatctctactaaaaatacaaaaaactagctgggcgtggtggcaggcacctgcagtcccagctacttgggaggctgaggcaggagaatggcatgaacccgggaggtggagcttgcagtgagctgagatggcgccactgcactccagcctgggcaacaaagcgagactccgtctcaaaaaaaaataaaataaaataaaaagtaaaataaaaaaataaaaaaaaattgttgtgttcagtgggagataatgtgttaaggaaagaaagatgttaagttctactacttgtagataggtggaattattgtgtcctttgtattgtttttgctttcctgtcataagatattccttggtttaataccataataaatacataaaaatacacataagaaactaaacaataaaaagaatgtgttaaataattttttttttttaccatttcaggttttttttctttctaattcagttaatcagtcccgctttgcttgtttgtcaaggttcttcaacttgcttaaaaactttttcaaattggtcaaaaattaatctttcaaattactacaggcttacaaaacttttatgcaccatgcaaacatcatgagatgtagtatgggaggtaaggaatatttaacctgcttcaaactttaagtattggacatttggattgttttccactttaccccgttaccgacaaagtggagcagacataactgattaatatttttaaccaaatattttgacttaagtatcgaattcctttggggtcttgaaggatataatacactatgaaagaaaagtagaaggtgctgatgatacaacgaattaggaggacctattttgtcgtgggaactttagagaagactttttgaagaagagtcacatgtcctacctcaatcagtctacaagcgcaaggaaacaacttagagttcgacaaagtcatatttatagattcattgcagtgagggagatcacacacagaactgtgaggcatctcactcaccaaacaaggacaagataatcattacaggatttgggggaagagtagagtttgggtgagatttaaatgaaaccatttaagtggcttttgatgaactcaaagcaaatcaggagtcaacatcaggtctgggcaggatccaggggtctgcttccttgaaaactagaaagttaagacagatatggattattgtgtccagaagcccttttcttaagctctgtggctggaatggaaatggaggctgattctctgtgtcaaagtgttttagagtctccaagacactatgatgttttatgttataataatataatttcaaagaacaaagtttcttagcaagtaagaaaacagtaatcactcaaagaatggggttgttatgaagctttatcgcatgtctttgggataactagtttcccgtaaactttgcagctagttttatcaatgtttattaatccagcttgatgagtgatggaacagatttttactttctaagtcctagcaaaagctttccctaaaaagagaggaccaaccaagagacaggggaaaataactttctggaaagaacaaaaaaacaagcatgaaggttgtgagctggttctggacacatttaagaccctaaaaaccaacaggacaatgacacaggcaacaaatgatttgaaatgatggagagataggggcagatctttcaggaagctgctagccttagttaggattttgcatttcatcaaagagtagagggaagtcactaaaggattctaatcaggggaattaccgaatcttcatcttctaagatagagaatgcattgtcataggcaatagtggaaggtagatgaccgtttggaaagttgttgcaagagaggatgatagtttatactagggtggcagcagtaaagaaggcagaaatggagagattcaagacaaaattttaggtagaaccaaatggtcttagtgagagtttgaatgtgtaacatgagggagatggagtcagggataatatccaggttctggcttgaatatccgagtagaaggtggcatcattaggatgtggaagactggaggtgaggcaggattgatggaaaagaacaagtacagctgtagacatcttacatttgtgcgacatttaagtaagaatgccttgaaagcatttgggtatttggatctgaggttgagaagagaggattgagttggtgctaaatatggagtcataagtatatattcaaagccatggaaaaaaaagtaacatgagaagagaaaaaggatcaggaccaagtctaaaggaactaccaaatccagaggtgaacaggaggacaggagccagcaaggaagcccaggcaccatgaagatggctgaattcacttatgaaaagcttggtttgatgctttgatgttaactcagttgtacttgtcatcaatttcttagagaatcgagagctgaaacatattctgaactgccttctatttttattcactgctttgtattatctgtagtcatctagttagacaattcctttcctgcaatgcctgtgatggaagccaggaagcatttatttctttgcgaagcatttggaaaatataaacatggccgggcgcggtggctcatgcctgtaatctcagaactttgggaggccgaggtgggcggatcacgagttcaggggatggagaccatcctggctaacacggtgaaaccccgtctctactaaaaaaatacaaaaaaattagctgggcatggtggtgggcgcctgtagtcccagctactcgggagcctgaggcaggagaatggcgtgaaccttggaggcggagtttgcagtgagccgagatcgcgccactgcactccagcctgggcgacagagcgagactctgtctcaaaaaaaaaaaaaagaaaaatataaacatgcaaatgacatcttatcacagcactgaacagatgttttaaattgtatttatttatttattcatttatttatttagacgaagtctcgctctgttgcccaggctggagtgcagtggcgcgatctcggctcaccgaaacctccacctcctaggttcaagcgattctcctgcctcagcctcccgagtagctgggactacaggcacgtgccaccatgcccggctaatttttgtatttttagtagagacagggtttcaccatattggccaccgtgttggccaggctggtcttgaactcctgaccttgtgatctgcccacctcggcctcccaaagttctggaggcgtgagccaccgcgccaggccatttttaattttattttaagcctgtgttctaaccacatcatttacctgcaggtccttggatacaatatgtacttttgagtctgagtctgtgctcacgttgttccttctgcttagaatggcctctctttccccttctctacctaatcaagtcctacttaacttttaaaacccagctctagtggcatgctcctctctgagccttttgttgttctaataaggcgtaactaatcactcctcctaaatacactcacagtatccagctcattccattagtacagatcttttcatgttttactttgctaaggtatagacaaatatatctgtctctaccattggactgtaaggttcttaagtgaccatgagttattcaactttacgtccctcatacagagaacaaatcttgttgaatttacttgcatgtaattggagatgacatggcaaagaataatgtggatatatcctgctcagcttcagataaacgctatgacatatgtaaacaaaatattcagctaacttttaaactttacatccaattttgacttatataggatgtaaactgcatacatgtacatatgcttcagacctttgaacatgctgctttctgtctggcatatgcccctatcttctctctcccacacaagtccacccatctctcaattttagtttataggctttttttttttttttttttttgagacagattcttgctctgtcgcccagactagagtgcagtggtacgatctcggctcactgcaacaaccacctcccagattcaaacgattctcgtgcctcagcctgccgaatagttgggattacaagtgtgtgccgccacgcccatctaattttttctatttttagtagagatggagtttcactgtgctggtcaggctgatcttgaactcctgggctcaggtgatccacctgcctcggcctcccaaagtaagcccggccattttttttttaagagataatatctcagtctgtgacagactggagtacaatggcgctatcaattttagttctaactaaactgtcaacaaaatctttgactaccttctctctctacctcaagatagcttgctcaattgcaatgtcaccctgcactctcattttacaacacacatcatcttttagtttctcagtaagtgttgctttctctctacaactgaaagctccaggaggcagggacaaaacctgtagtttttcttttctttttttcttttttcagcaaagggagggctgattttttaactttttgaaaatagatgaaagtaaacaataaaataataaaacctcacatgccatcgctcagcctcagtaaccatcaacccatggccaatcctgtccctactgcaaccctgcccattccctacactcacacattattttgaagtaagtcccagacaacacatgattttatttgtaaatatttcagtctgtttctgaaatgactcctttttgtaacataaccacaatgtcattattacacctaagaatgaataatatacctctttaatatcatcaactatccaggcagaattcagatttttaattatctctttcagacaatctttttaatgtcttttcttgaatcaggatacaaacaaggttcacacattgagattggctggtagtctattgtctctttttacctaccgattcaccttctattttttctttttgtttcatcacttataaatataaatactatttttttaatagctatgtctccagttcctcacccagtcttggtcatagcaggttttagataaatattgtatttgatgaataaatgaatgaatacaagtaatgcataattgagaaatctcaggagataccaaaagaaatgtaatttaataataatctttgatttctctgatctcatatttcttcaatgttctctaaatttaaaattttatttgatacataataaatgcatacttttgaggcagaaagtattattctctgaaacatttctaagaaattaatttaccctggaattgtcataattagttaattttaactacttcccctatataaaattggtgacttgggcagcaagacaaaaaaggtttctattgttaagtaagacttatttttcttcctcaagaaatcatcactagtaagcattgcaacctttactttgctattgttagatgtggcaacaactcgtgctggactcgagaaaattgtgcaagcttgaattaaataattgcttctaaatttgcttataaggaagtttattgtcttaccagggactaacactacaaatatggaaatggagtcaagcagtgattcaatgtagataacataattggaaactgggagaaagaatgttcattcaacaatcgagaaaaactaaaataaaagttaaactttacttcatcaatgctgggtccaaattaattaatgaaaacagaaataaaactatgcttcctaggataatattgacagtatttttaaaagtttattattttttaaaaagattattatatgaagagtaaaagtctttctatctctctagcctcccttattcagattttcagaggtaaaagcattgtttcttatatatccaggcattttcctatcagaatgtccaacatatgtatatttatatatagtcatgcacctcataattacatttaggtcaatggcaggccacatgtatgatagtggatggtcccataagattataattgaactgaaaatttcctatcatgtagtgacatggtagctttcataacctggtaacacagcgtattgctcacaggattatagtgatgcgatgcagacaaacctactgcactgtcagctatgtaaaagtatggcacatacaattatgtacagtacataatacttaatgataataagtgactatgttactggtttatgtatttactatactatactttttatcattattctagagtgtactccttctacttattaaaaaaaagttaactgtaaaacaaccccatgaagagtaatatattctagatacacttctgtacttgcctttcacacagttgatcatgttgttcaaattgtccagatttgggcattagtagctcctttaagttggctccgatgtcttgtagacttggcccccattattttgtgaacatgtctttactttctggcactttaaatggtctaagctcatcttgcattcctcctgctctagtctggactcagtcatttccccagggagctctggttcctttcatcgagaatggtatttagaaaccaagatctggaaactagttgtgctcattgctactgggatctcactgcatgtatatccatgagttcacactgatattcctgctctgatttcaatctggagtttgtgctacttcacaatttctctattttaactcttttatctgacagaaaactggctctcaatatccacagtgtatttcttaattactcaatcctagtatatacataaagtagtttcagaaatactaacccataccctatgaaaaacaaatttactaaagtacaatattttcatacagttctttctgtttttagccttctagtatatggttaaaataatgttctccaggttatgttagataattcttttattttttatcccatttagtataattatgtcatttatttgtaatacagttgggcttatttgttactgcttatattccattttgggtcttcccttccccaacatcctggttaattttaattatttatttttttgggggggggtgaaacattaccatatttataggaattagagctatgcatataggaatactctgagtgtgtcacatctctctaatcatttctacccatttttattccccaatttttccacgctgatcctacttaacctctgtaggtgacgaatctcatttgtttctagtttaactttccagtatgtttttcctcatatatgtggatatatgtatattttcttatatatacttctttcttacatgaagagtagtatactctagatattcttctgtactttgctttccacataagaatataccttggaaatctctgaatatgaatccatagagctcttcctcatttattttatagctgcatagtgctctcttgtgtgaattgttagagtttatttaaaaaccactgttctatatatgagtatttaatttgtttcttaaatttagcaattatatataatcttacaatgaataaacttgtacatatgtttttcatattgttggatatgtatcttcagggtagattttataagtgagattatagggctccttatgtagttatattaggtattgccaagtttccattgagaagggttgtagcagtttgtattccttaacagcaatgaaaagagtgattattttcctaagatctggctaacaaaatgtgttgtcatattttaatttattacattttattagttaaaattttattttaatttttacccatctgataggtgagaaataatagcttagcatttttttaatctgcatttttctagttatgaatttgcactttacaggtatatatatgtatttttctttttaaaaaattgtattttaagttctggggtacatgtgcaggacatgcaggtttattacgtaggtaaatgtgtgccacggtggtttgctgcacctactaacccatcacctaggtatcaagccctgcatgcattagctatttatcctgatgctctccctcttcccaacccgctgacaggcccgagtgtgtgttatttccctccctgtgtccatgtgttctcaatgttcagctcacacttatgagtgagaaacatgaggtgcttggttttctgttcctgtgttactttgctgaggatgatggcttccagcttcatctgtgtccctgcaaaggacacgatctcattcctttttatggttgcataatattccatggtgtatatgtaccacattttctttatccagtctaccattgatggacatttgggttgattccatgtccttgctcctgtgaatagtgctgcagtaaacatacacatgcatgtatctttataatagaatgatttatattccttttggtatatacacagtaatgggattgctgggtcaaatggtatttctggttctagatccttgaggaatcaccacactgtcttccacaatgcttgtactaatttacattcccaccaacagtgtaaaagcattcctttttctccacagcctcgccagcatctattgtttcttgactttgaaaagtgattatatgtatatttacggatcactttttcaacagccttgttaaggttgtggagacaaaaaccaccccatcttggatgctaatccaccatgttgacttctgattagacccagtcccatgaataacttctggtttctactttatttactgtccctagtataagatcaaaacaaccctgatgttatcacacaaattataggctaggacacacatagcattttcgcctgttctggagggttgcctttaatcgtttttgctggagcatgtgtaccctttccatacggtacccaaaccttgggtctgggaaataacagtgtggagatctacctgtcttgcagtcatccaagatcacacttctgtccataagttcctcagtaaatcacccattactgacgaactggatttgttcacttccttctttggtttctgggcttcttcagcatttgggaatagctttgtgtgcacagccttttcacagaacaaagatatgacctactttctgtttctatagagttgttaaagccatttgtgtgtctctgtgtgtgtgtgtgaattgtctattgatgcccttttcccattttttctaatgggtgcttggtgcttgatctcttaatttctaacaattatttacatattaggaatattagcccttttcctgtaatatatgttgaaagcatgtttttaacctggttgtcagttgtcttttgactttgtttatgatatttatcatgcagtttatttttatgttactagattcatcagtcttttataaatggcttttagatttagatttataaccattgccaactgctggctcctccagaaaccaccaaaatggtttactgatgaacaaaaaccaagtttattgctcactgcagtaaggaagatgactgtcttcacataatcttagtagcctcagaaaagggagtcaagggtgggatattggtaagctttggggagtctggttctaaggtatgtctttcaacatgaggtgtgcagtcctgactgggatagggtaaagtttggattgctggatacagtgaggcaagacctataaagccagccttgaaaggtaaacagtcacttgaaaacccagttgagtgatctactgttctgaaaagaaggctgtttagcccgatgaggctgtatgagtacagatacatagatcggaaagtttccaggacaaaaaagtaatttcaactttactttcttaggcaaggatttcttggaatagtaaagtcatcttagtgcagacagttcctaatctctttattttttatttttagagacatagtctctctccatccattaggttggaattcagtgttgtgatcataactcactgaaatcataagctggaatgcctgggcccaagtgatccttccaccgcagcctcccaagtagctagggctacaagcacatgccaccatgcccagctaatttttaatcttcttatatagagacagattcttgttatgttggcaagactggttttgaactcctggtctcaagtaatcttcctgccttggcctcccaaagtgctaggattacaggtatgagccaccatgcccaaccaaacagttcctaatctttttaagctgtgtggcttcaggttgcttttgttctcaacatatcctctataaatagattcctaccattggctgcgcgtggaggctcacacctgtaatcccagcattttgggaggccaaagcgggtggatcacctgaggtcaggagttcaagaccagcctggtcaacatggtgaaaccccgtctctactaaaaatacaaaaaattagccaggcatggtggcagatgcctgtaatcccagctacttgggaggctgaggcaggagaattgcttgaacccgggaagcagaggttgcagtgagccataagccaagatcccaccattgcactcaagcctgggtgacagagcgagactctgcctcaaaaaaaaaaaaaaaaaaaaaaaaatcctatcatctcttttatcttcaggtcatctttttctattttgatgtgtaaattctagttctatgttcttttagttttctgcaaaagagtacatggggatatatttataaatgcatgcatattcaaaaattttcttctgcccttacatgtaaatgataatgtgaatttcatttaggatttttgaatcatatttttgtacaatattttcataccgttctttatgttgaaggggttcctgtagcagcctgcattttcttctgcagtacttaccacaatcagaagttacgctccatcaaggcagtgagtatcaggtttatacactgctatattcccaatgcctagaaaaatgcctgacatatgataatacctcagtaaacatttgtcaataaataagtgaatgaggggcgggtgcagtggctcacacttgtaattgacactttgggaggccaaggcgggaggatcgcttcaatccaggagttcaaggccagcctggacaacatagtgagatcccatctctacaaaaaataaaataattggccatgtgtggtggtgcatgactgtggtcccagctactcaggaggctgaagtgggaggactgtttgagcccaggaggtggaggctgcagtgagccatgattgcaccactgtactccagcctgggtaacagagcaagtctctgtctcaacaactagaaaagaaaagaaaagaataaatgaatgaattagaggttgtatatgtaatgtatttcttctcctctggactataaacttaacagaaagaggaatcttctacattgtttgcctcttgtgtttcataacaaagtatctgcctcataaagatgttgcatacatttttgtaagccagtgtatgtttgcataagtgaaattcagtaaaatgcattccggtaagactcaagtagaaactaattatatattcttcttccttcctttccttttccttttccttttctttgtcttactctttctgttacccaggctggagtgcggtggcctgatcacagctcactgcagccttgaccccactaggctcaggtaatttttccacctcagctttctgagtagctgggactacaggcacacaccaccatacctggctaatttttatactttttctacaaaaatacaaggttttgccatattgcccagtctggtcttcaactcctgagctcaagtgatccacctgccttggcctccaaaagtgctaggactacagttgtgagccactgtgcccagcctaattacatattcttatttcaagacctctttgaagataaacctttagtgctaaataatcattcagtatcatatcctctcagcttctaggaccaaatatttggcttatctcaacaacatgtattcagaatgcccaattcaatcttgtctttgcagaaaaaatcattttctcttatacacgatcccaaaatatgcaagaaaatatacatatttttctcttctcccccttgtttcataaactggtgttgagtttttaatttttattgatggtttggaatttataatgaaaatgaaaatgctgatgaggtctttggctgtagtaacaagaagtactacagatgactcagagaataaagctgcctcacattacattaaaactcatctcttggaaaatggtgtaaatggttgactggagatgaaggtaatttatcaatttatgtggttgaggcatattacatgatcttaactttcataaaattaaatctgaatatataacaatttgaaataccttaatgctaagccttatcatttggcgaagccccttttatcaaattgaaactctaaaattacctaccatcatttatcccaatggtataacatgtcaatggcttacaatgtatcatttattttcataatccatccttcatgaaaaatattacctaaagtgtttaccataaaagtgagtgacacctaaggcaaagaaaaataacaaaaatagaattaaagagaaaggactcagaggatggaagacattgatttaggaagaatgaatgacggagttataggagcatcctataatgttaagttgttacatcttgctaaaggccaagctcattctgcatatgtgaagagttgattgcattatttacatagatgtatcttgggatttgaacaaagttgtaagtcagtatagaggaagttgggcattccagggtgagcctattagcgtcctccagagtagaaatattggaatggtctcatacagaagagatagaatataggataattcgtcattgattacttcctctgaattaggatatatttataatactgtttttaaaccagataaaactagagaaaatctcaagtaattagtcaatttattgtattccccatctttcttctctgaaacattccctaggtatacagtagtgtaaatatacatttcaaaagagagaggtgctacagaccctctttgcaacctgtatgtgtatccaatcctcttgtcttcttcttcattctgtttcaagaggattacacttttaaaatgtcttttgaattcctgatcgccttaccattccatttccactgccttgtcacctttcacaaagagtactgaggtagcttctttaaaaaatatgtatagtttcaacttttattttagaatcagtgggtacatgtgcaggtttattacatgggtatgtttcatgaagttgagtccgttacccaggtagtgagaaaaatacacaatagttggtttttcaacccttgtccccttcttctctcctccctctagtatttgccaggatctatttttcccatctttatgtccatgtgtacccaatgtttagctcccacttataagtgagaacatgcagtatttgattttccatttctgtgttaattcacttaggataatggcctccagttgcatccatgttgccacaaaggacataatgtcattcttttttatggctacatagtattccatggcgtatatgtaccacattttctttatccaatccaccattgatggacacctaggttgattccacgtttttgctattgtgaatagtgctgtgattagcatacaagtgcatgtctcttttgtgtaaaattatttattgtcctttgggtatatacccagtcatgagattgctgggtcaaatggtagttctattttaaattctttgagaaatctccaaattgctttccacagtggctgaactagtttacattcctacaaacagtatataagtattcccttttctctgcagccttgccaacatctgttattttttgactttgtaataatagccattctgattggtgtgagatggcatcttattgtggttttgatttgcatttctttgatgttgatataatcaccaaaaacgtaaacatttcagttgctattggttacatgttacgttttctgttgtttttattgttgtgtagttcctcctgagctggttcggctctgtgtccccacccaagtctctcaccttgaattgtaataatccccttgtgttcttggaggaaccccgtgggaggtaattgaatcatggggagggggtttcttcccatgctgttctcatgatagtgagtaagtctcatgagatctgatggttttaaaaaggggagttctcctacacatgccctcttgcctgctgccatgtaagatgtggtttttgccttacaccatgactgcgaggcctccccagccatgtggaactgtgaatcaattaaacctcttttctttacacattacccactctcgggtatgtcttcattagcaacatgggaacagattaatacagtaaattggtactgggtagtggagtgctgctgtaaagacatcagaaaatgtggaagctactttggaactgggtaacaggcagaggttggaacagcttcgaggactcagaagaagacagaaaagtatgggaaagtttggaacttgctagaggcttgttgatggctttgaccaaaatgctgaagtgatatggacaataaagtacaggctgaggtggtctcagatggagatgaggggtttgttaggaattgaagcaaaggtgactcttgttatgctttagcaaggagactggtggcattttgcccctgccctagagatttgtggaactttgaacttgagagagatgatttagggcatctggtggaagaaagttctaagcagcaaagcattcaagaggtgacctgggtgctgttaaaagcattcagttttatttattcacaaagatatggcttggaattgtaagttatgtttaaaaggaaagcagggcataaaagtttggaaaatttgcagcttgatgatgtgatagaaaagaaaaactcattttctgaggagaaattcaagccagctgcagaaatgtgcaagtaacaaggagccaaatgttaatacccaagacaatggggaaaagtctctagggcatgtcagagaccttcctggaagcctctcccatcacaggactggagacctaggaggaaaaaatggtttcctgggccaggtccagggctccattgctgtgaggaacctagggacttggtgacctacatcctagctgctccagccatggctaaaaggggccaaggtagagctcgggttgtggtttcagagggtgcagcttggcagcttccacatggtgttgagcctgtgggtgcacagaagtcaagaaccaaggtttggaaacttctgtctcaatttcattggatgtatggaaatgcctgaatgtccaagaagaagtttgctgtaggggcagggccttcatggagaacctctgctatggcagtgcagaaggggaatgtggagttggagcctgcacactgagtccccaatggggtgctgcctagtggagctgtgagaagaggggcactgttctccagaccccagaatggtagatacactaacagcttgtgctgtacacctagaaaagacactcaatgccagcccatgaaagcagccaggagaggggctgtaccctgcaaagccaaaggggtggagctgcccaaggctatgggcgcccagttcttgcatcaggatgtgagacatggagtcaaagaagatcatttcagagtgttaagatttggctgccccgctggattttggacttgcataggccctgtaacctctttgttttggccaatttctcccatgtggaatgggtatatttatgcaatgcctatacccccattatatctaggatgtaactaatttgcttttgattttacagactcataagtggaagggacttgccttgtttcagatgaaattttgggcttggacttttgggttgatgctgaaatgagttcagttttttgaggattgttgaaagcgcatgattgtgtttttgaaatgtgaggacatgagatttgagaggggccaggggtggaatgattgtagggaaaagaaagagagatcagactgttcctgtgtctatgtagaaaaggaagacataagaaactcattttgatctgtaccctgaacaattgttttgccttgagatgctgttaatctgtaactttagccccaagcctgtgctcacagaaacatgtgttgtatggaatcaaggtgtaagggatctagggctgtgcagaatgtgccttgttaacaatatgtttacaggcagtatgctggtaaaagtcattgccattctccattctcgattaaccaggggcacaatgcactgcggaaagcctcaggggcctctgcccaagaaagcctgggtattgtccaaggtttcccccaactgaggcagcctgagatacggcctcgtgggaagggaaagacctgactgtcccccagcctgacacccataaagggtctgtgctgaggaagattagtaaaagaagaaggcctcttgtggttgagataagaggaaggcctctgtctcctgcatgcccctgggaatggaatgtctcagtgtaaaacccaatcatacattcattctattctgagataggagaaaactgccctgtggctggagatgaaatatgctggcggcaatgctgctctgttactctttactacaccgagatgtttgggtggagagaagcataaatctggcctacatgcacatccaggcatagtaccttcccttgaacttatttgtgacacagtttcctttgctcacaggttttcctgctgaccttctccccactatcaccccgttctcctgccacattctccttgctgtgataatgaaaatagtaatcaataaatactaaaggaactcagagaccggtgccgatgcaggtcctctgtatgtggagcgctggtctccttggcccactgttcttttgctatactttgtctctgtgttttatttattttctcagtctccccatcccacctgacgagaaatacccacagctgtggaggggctggcccccttcagatgatatggtttggctctgtatgcccacccaagtctcaccttgaattataataatccccacgtgggatcaattgtgggaccaggtggaggtaattgaatcatgagggtgtcttctttccatgctgttcttatgatagtgaataagtcttacaagttctgatggttttataaaggggagttcccctacacaggacctcttgcctgccaccatgtaagacgtgcctttagccttccaccatgattgtgaggcctccccagccatgtgcaactgtgagtcaattaaacctctttcctttatacattacctagtatcgggtatgtcttcattagcagtgtaagaacagactaatatgctgcttctacagtttattgaatttaacttttaaatcaagttgtgattttattgttgttgttgtctttgagtcttgccatccaaatcaaaactgggctaatttgtggaaataatatctattgggttaaggagagaattgttagatgcagcctaaaagaaagaatttagtgttcactgtatctatcatgaaaggctctttctatttgttttctattataaagtaatatgctgtatttcatggcaaaggctttaaattgaaaactccaaggcttaaaatttaagccttgcatttggaaatagacaactagctctacagaagtagttttgttttgtttttgtttgtgtttttttgcagtggggggctggtatttgggggcagggagaggggaaaaagtccatttgctggtactgagtgactttgggcaagttacttgccctctgtaagcctcaatttcctcatctataaaatgggatattagctttcttgtaggattgttgggagaattaaatgagataaggaatatctgtaaagcagttaacatgaaacaggccctcaataaatggaaactaattttattgtttgtaatagaaaacaacaatgtgtcagcttctagtaataactttaaaatattctatgcatactatatagcaaaggcagttttacttctaatcacagaacatataacactaagtatagttctaatacttaagaagcaaaataacaccagggcagtaacaaatgctggagaggaggtagagaaaaggaaaccctcatatgttgttgatgagaatgtaaattagtacaaccactatggagaagagtttggaggtttctcataaaagtaaaaatagagttaccatatgacctaacaatctactgggtatatactcaaaagaaaggaaatcagtatatagaaaatatatttgcactcccatgtttgttgcagcactattcacaacagccaaaatttggaagcaacctaagtgtccattcacagatgaatggataaagaaaatgtggcacttatctgcaatggattactattcagccataaaaaagaatgagatcttgtcatttgcaataacatggatggaaccggaggtcattatgttaaatgaaataagccaggcacagaaagacaaacatcacatgttctcacttatttttggatctagaaatcaaaacaattgaaaacatgaaaatagagagtagaaggatggctaccagaggctgggtagtgtaataggggtggggtgggtagggaggtgaggatggttaatgggtacaaaaaaaatagttggaaagaatgaatacagccgagtatttgatagcacaacagggtgactatagtcaataataatttaattgtactttctaaaataactaagagtataatgggactctttgtgacacaaagaataaatgcttgaggtgatgaatactccattctccgtaatgtgattattacatattgaatacctgtatcaaaatattacatgtaccccataaatatatacacctataatataccctcaaaaattaattttttttttttgagatggagtcttgctgtcacccaggctggagtgcagtggtgcgatcgcaactcactgtaacctccgcctcccaagttcaagagattctcctgcctcagccttctgagtagctgagattacaggcacgtgccaccacacccagctaatttttgtatttttagtagacatggggtttcattatgttagtcaggctggtcttgaactcctgacctcgtgatccgcccacctcggcctcccaaagtgctgggattacaggcatgagccactgtacccggccaaaaatcttaaaaaataccaggggacatatcagcatagctgagccactctgactttttatcagtttccggaagacacccatctccttcttacctctaggcctgtgtatttccattcccttcagcctggaaagctcttatccaagctatttacatggctggcttcttattctttagttgttagcttaatgtcaactccttacagacaccctacctgattatcttagctcaattaggccgttccttgctctagtcactattatagcatcctatatatttccttcagagaggttgtcacaacctgaattaccttatttttttgttcttgtttacttgcttactatcagtctctcccattaagctccaatgacatggtcaaggaccacatctacttgtggcccattgaagaccccttgcctaacacagtgtctggtacatgttgaattgtcagtaaatatttgttgaaacaattggttaataaatactgttcctgaaagcctctctgccactgtctctgcagtagaactgcccttgctaccctcagactaatgaagaagagaagaccctaagtaccttatttatacctccaacaagctgcaatcaacccaagaagaggaggccagtccgtctcccatggttcccacacccccaacccccactcatcaccagagagaacccctggcttgagcccacagcacagacccttcatcctggggtgattgcactgaggaattgctgacctacatctctctggtgtggagctcccaggatacaagcaaaagacccctgaccacaaccactactaaggtcctttcctctgttgccgccaagttgaggaaggaacgtaaacactgacattgccccagagctgcagtgggcagccaggagtgtcaaaccacaatctacagccatacagctggcactcaagggggcgaggaacccacactttcagagcatcgagagtgaacacagctgtaactatgagaaaacatagaggagccacacaactgagcaagagtctaccagttgaccaataagcctaagtgccacctactggatcacaccccaaagcttcaacaccaagaatacctcactaacatactcacctctgaaactagagacaagaagtcagcttcaaaaaaagaccctgcacaaggcctcagcctagtgaaaacagccagaagtctattgactgtactcaatctatatggcagttaaaggaacacccacacatggagatgagaaagaactaacgcaagaactccaaaaattaaaatggccagagtgtcatatgtgctccaaatgaccatacaaattctctaacaagagtgcttatccaggctgagctggctgaaatgacagaaatagaatttaggatatgtataggaatgaagatcattgagattcaggaggacagcaaaacccaatccaaagaaaccacaaatcacaataaagtgatacaggagctgaaagacaaaatagccagtataataaagaacctaatgggtccgacatagctgaataacacagtacaagaatttcacaatgcaatcacaagtattaacagtagaataaaccaagctgaggaaagaatctcagaactcgaaagctggctttctgaaataagacagtcagacaaaaataaagaaaaaagaataaaaaggaatgaacaaaacctccaagaagtaggggattatgtaaagaagccaaatctacaaatcactggcatccctgaaaggaagggggagaaagcaaacagtttggaaaacatatttcaatatattgtccatgaaaacttccacaaccttgctagagaggacaacagtcaaatacaggaaatacagacaactcctgcaagattctacacaggaagatcatccccaagacacataattgtcagattttccaaggtgaaaatgaaagaaagaatgttaaaggcagccagaaagaaaaggcaggttacctgcaaaggaaatcccatcaggctaacagtggacctctcagctgaaaccctataagccaaaagagattgggggcctatattcaacattcttacagaaaacaatcttcaaccaataattttatatgcagccaaactaagcttcccaagcaaaggaaaaataagattcttttcagataagcaaatgttgaaggaattctttactaccagacctgccttacaagagatctcaaaagaagcactaaatatagaaagaaaagatcactacgagctaatacaaaaacacacttaaacacacagaatagtgtcactgtaaagcaaccacacaaacaaaccaacataataatcagctaacaacacaatgacaggatcaaatccacacctaacaatggtaactttgaatgtaaatgggctaaatgctcaacttaaaaggcacagaatgacaagatggataaaaaagcaagtcccaatggtatgctgtctttaagagacccatctcacacataatgacaccaaaaggctcaaaataaaggcatggaggaaaatctaccaagcaaatggaaaacagaaaaaagctgaggttgcaatcttaatttcagacaaaacaaacttcaaaacaacaaagatcaaaaaagacaaagaagggcattacataatggtaaagggtacgattcaacaacaagatccaactatcctaaatgtatatgcaccgaacacaggggcacccagattcatgaagcaagttcttagagacctacaaacaggcatagactcccacacattaatagtgggagacttcaacactccactgacaatattagacacataattgaggcagaaaattaacaaagatactcaggacctgaactcaacattggaccaaatggatctgatagacctcttcagagctctctactcaaaaacagcagaatatacattcttcccatcgccacatggcatctactcgaaaggcaactacttaattggacgtaaaacaatcctcagcaaatgtaaaataactgaaataatacgaaacacactctctgaccgcagcgcaataaaaatagaagtcaaagaccaagaaaatcttcaaaatcaggcaatgacatgaaaactaaacacgctccagaatggcttttgggtaaataatgaagttaaggcagaaatcaagaagttctttgaatctaatgagaacaaaaatataacataccagaatctctaggacatagctaaggcagtgttaaaagggaaattcatcgcatgaaatgcccacatcaaaaagttagaaagatctcaaattaacaacttaacgtaacagatgaaggaattagagaggcaagaacaaatcaaccacaaagctagcagaaaacaagaaataaccaaaatcagagctgaaatgaaggaatctgagacacgagaaaccattcaaaagatcaacaaatccaggagttggttcttttaaaaaattaataagatagataggctactagctagactaataaagaagaaaagagagaagatccaaataaacacaactggaaatgacgaagggaatgttaccactgaccccacagaaataaaaataaccactagaaaccactatgcactcaaactagaaaacctagaagagatggataaattcctggacacatacaccctcccaagactgaaccaggaagaaactgatcccctgaatagaccaataatgatctccaaaagtaagtcagtaataaatagcctaccaaccaaaataaagctcaggacctcatggattcacagctgaattttactatatgtacaaagaagagctggtaccatttctataaaaactattccaaaaaactggggaggaaggactcctccccagctcattctacgaagccaccatcattctgatacaaaaacttggcagagacacaacaaaaaagaaaacatcaggccaatatccttgatgaacatcaatgcaaaaatcctcagcaaaataatttcaaactgaatccagcagcacatcaaaaagctaatccaccatgatcaaatagacttcattcctgggatgcaaggttggttcaacatacgcaaatcaataaatgtgattcatcacataaacagaactaaagacagaaaccacataattatctcaatagatgccgaaaacgctttagataaaattcaacaccccttcatgttaaaaactctcaataaactaggtattgaaggaacatacctcaaaataataagagccatgtttgacaaacccacagtcaacatcatactgaatgggaaaagctggaagcattccccttgaaaactggcacaagacaaggatgccttctctcaccactcctattcaacatagtattggaagtcctagacagaacagtcaggcaagaaatagaaataaagggcatccaaataggaagaaaggaagtcaaactatctctctttgcagatgacattattctatatctagaaaacctcttttttttttttttttttgagacagagtctcactcttgttgcccatgttggagtgcagtggcatgatctcggctcaccacaacctccgcctcctgggttcaagtgattctcctgcctcagcctcccagagcagctgggattagtgatatacaccaccacacctggctaattttgcatttttcaatagagacagggtttctccatgttggtcaggctagtcttgaattcctgacctcaggtgatccacccacctcaacctcccaaagtgctgggattacaggcatgagccacaacacttggcctatatctaaaaaaccttatagtcttggcccaaaatttccttcagctgataaacaacttcagcaaagtttcaacatacaaaatcaacgtacaaaaaacactagtattcctatacaccaacaacagccaagacaagagttaaatcagaaaggcaatcccattgacagaaagaatcaaatatctaggaatatagctaactagggaggtgaaagacctctacaatgagaattacaaagcactgctcaaaaatatcagagaagacacaaacaaatggaaaaacattccatgctcatggataggaaaaatcagtattattaaaattgccatactgcccaaagaacttacagattcaatgctattcctactaaagtgccaacaacctttttcatggaactagaaaaatctattttaaaatttatatagaaccaaaaagagctcaaatagtcaaggcaatcctaagcaaaaataacaaagctggaggcatcatgttacctgacttcaaactatactacagggctacagtaaccaaaacagcatggtaatggtacaaaaccaggcacatagaccaatagaacagaatagagagcccagaaataaggccacacacctacaataatctgatcttcaacaaagctggcaaaaacaagcaatggggaaaagactccctgttcaataaatggtgctggggtgactaagcagccacatgcaaaagattgaagctggaccccttctttataccatttacaaaaataaactcaagatggactaaagacttaaatgtaaaacccaaaactataaaaactctggaagacaacctaggcaataccatcttggacacagaaacagacaaagatttcatgacaaagacaccaaaagcaattgcaagaaaagcaaaaattgacaagagggatctaattactcttaagagcttctgcatagcaaaagaaattatcaacagagtaaagagacaacctacagaatgggagacaattttcaaactgtgcatctgacaaaggtctaatatccagcatctataagaaacttaaacaatattacaagagaaaaacaaccccatagaaagtgggcaaaggaccccttagaaagtgggcaaagaacataaacagacacttttcaaaagaaggcatacatgtggccaagaagcacatgaacaaaagctcaatattactgatcattagagaaatgcaaatcaaaaccactatgaagataccgtctcacaccagtcagaatggctattactaaacagtcaaaaaaaaaaaaaaaaaaaaagaaaaccagatgctggtggtgaggttacagagaaatgagaacatttatatgctgttggtaggagtgcaaattagttcaaccattgtggaaagcagtgtggtgattcctcaaagagctaaaagcagaactaccatttgacccagcaatcccattactgggtatataccctgaagaatataaatcattctaccataaagacacgtgcatgcaaatgttcatcttggcttggtttctcattcttttgttcacttttcggagtcattttcctaccattcatttgtgcatgcagtgtctgaatttcagataacaaactcctatgtgctttctggaggcattccatagctgcttgatattcaacagcactattcacagtagcaaagacatagaatcaacctaaatgcccatcaacaacaaattggataaagaaaattgggtacatttataccatggaataccgtgcagccacaaaaaagaatgagttcatgtatttcgtgggaacacggatggtgctggaggctattatcgttagcaaactaacacagaaacagaaaaccaaataccacatgttctcacttataagtggaagctaaatgatgagaacttacaaatgtgaagaaggagacaacagacactggggtctacttgagggtggagggtgggaggagggagaggagaagaaaagatagctattgggtactgggcttaatacctgggtgatgaagtaatctgtacaacaaacccccatgacatgagtttacctatgtaacaaaccttcacatgtacccccaaacctaaaataacagttttttaaaaataatcaatattgtcccagtcctccattttacagatatggaagttgtgattaaaatgtgattaatgtcacagaaatactaggaaagccaagcttctaacagtcattccagggtcattgccagggtgtcaaatcctatgtcactgcacagtattactataacaacaaagtgtccctttcctgacttcctattccccattcttgatccagcatctttgggatccacttccaggcattttctctggggtcctgctggcttaagtcagccagatcctgcagtgcctttgccatatgatcctcccctcccttaacagacactgtacttacccagttggattatactgaaacttagtcctcatactgtctggtatcggggagagaagtgggggtagattctgagcaggaccaacattgttttgtaagacacttgacttactcgaagcttatagttttcaagcaaggagaaggtcttccatcttccagcaagggagtgggccacctctgtaggcccagatattccggagaagctgggaggccaaggtccttaagtgtgtctaataagtttccccattccaattctcatgttcccacttttttccaatcaggaccctgattctcttgaaggagacttacacaggctgagaattaaccttctctggcgttctgccactcataagtacaggctgcacctgggcttcagttcagttggccttctggctgccagtgatgagggactttttaaaggcttccatggaggccctttgactctcacacttgggtttaaattggtggttaatagatttgatcctggcatctatacttagtgcatcaatggtgcttaccaataccctcccaattcaacaatctttcaagttacttttccacctgtactctcaaatactagatacatcacagaagttaatgcattcgcttctacttatatgctgtcctggttcactacaagtaaaagtgttagcaatttcactgcaggagcacatctgagactatcttcagggaagagattctgatgggaccactggtgagtgagcaaactccagaatcccatccttagactcaggtgtatataactactactgctatcaactgtcttagattgggctcttgcagctgaccctgagaattagattcctgtccaagtgattgcctgagggagtgctctcagaagaaatctgaacagcgaggaaggaagcagaataggacaggaaaagaagctgggaaagatatgggtttagctgaagtctagcctcagtctgatcccacagggagttctggagcctcagttctgtacacccgtatcaatcagtcattggctgtgagctacccacgggggaaggctgttaccttccaggcattttctgaaattgttggcttgaatggaatcctcagggaaagagtgtgaactattagcagccaacactctcagcagctaagggatgagtacgccagctcattgaagagattctggacaggacaccaacagcatcttcagtaaagatgtacttcaatggtaaggacactgaacccagaaagaaggagtcacatgcaagaagaaatggtggaccaagaaatgtataaacatctggctatatctgaataagcactcttatacacaacaataatggggaacaatggctaatttggagatggagggtatttaaaaggcagaatttaaacaataaacattaataaggaatatggggtaattagtattgaaagtttctaaagcccttgtatttctgaggtgaagggtaaatacattaattaaatttagattttattatgtcaagttatacttgtaaaaatttaatggagctcccagatgtagggagtaaattaaacacatgcatcaaatttggtcctccccaaatccagttaatttgtcagtgaatttttttaagtcctgggccatgggaaaataaacaataataacacaattttggaaaattggatgagtgagaaaagacttagcagaactcccaaattaaagtactaaaccagcagcaggaaagccaagaagcaacttgttttacactcaagagccttcaagtgtcaggaattggcagcatcagattcttctggaagtgtggtgaagaggagagactaaaatgagaatgatgcgctgaaagtttatttaagaagcagtcagatcactagatcctttccaatcatgaaaaggtacactaccgcttctatttcccttctctttcccaggaagcatattcacaggagagagagaacaggtttcctgcttggggatcccaagcagagttgaagttgggagcactgtactgaacaaagccagcttaagaaaatgcatgcatactgaatgcccacctctctctactccactatctcgcttgacccagatccaaaatagtagtagcagactttgactcttctgacaggagattggaagaatcttacctgatcagtccaggaggaaaacctaaatgcagtaacatcagggttccctaactaagctgtccagaacttaccatcttcaccaaaacaagaaattaaaccaataaagtggaagatcagggcaacacacccaggacatacacccaggttgggagacacatgtaggagagtaagacagtgaggccagaatgatgctgagggaaagtcccaagatgacagctttatgtcttacgcatcaggcataaagaccaataggccatcagaagaatgaagcatattttgtcaggaagatgaaagcaatgcatcttagtagcttaagagaagatttagagaactggcaaataatttgggattaaattagtgataagtacatagaaaactaagcaaatggtaaaacaagataattagctccagggcaagcaaaaagctgctcaggaaagaaaaatttatcatagtttcctacatggctcagctgtgaacagtttgtgcatagttatattaatgtaaatatattgcttgatatcaaacgcaaacataatatgactgtattgtgagggcgtgaagaggaaagaaggcacatatatggtgggagcagtcattttctagagtgggaagtcagtagataataccaaaaactggaaaattgagaaatataagaaattgagaaatgaatgttttttagagacatggaagtagataccaacatgaccagtaaaagaaatgtaaatgattgtttcaggggaaggaaggagggatataaggctcatgaggaagtatctgatattttcaactatgagtttttaaaatttttggtgaaataaaatctaaatataaaaacaaagatggaatgggaatataatgaaatattcaactaaaaatatttcaatggcaactactgaaagaatgcaaagaaaatatataatttccaaaccagtatgaggagaaaaaagaaaaagagaaaaaaataaaacacttcagtaatcccttagaaaacaggaaagaagaatggaagaagcaaagcagaagcttggtaataaagaaaagaaaaaaaaagtaaaagaggctgagcacagtggctcatgcctgtaatccaacactttgggaggctgaggtgggcagatcacttgagcctaggagttcaagaccagcctggacaagatggtgaaaccccgtctctacaacaaatacaaaaattagccaggtgtggcagctcgcgtctgtagtcccagctacttgggaggctggggtgggaggattgcttgagcctaggaagtaaaggctgcagtgagctgagattgtgccactgcacttcagcctgggcaacagagcaagaccctgtctcaaagaaaggaaggatggaaggaaggaaggaagggaggaagggagggaggaaggaagaaaaaggaagggaagagggacggaaggacagaagagagagagagagagagagagtgagattcaactaaggtaaccaggcaagctttggaagagaagtgtaagaagaagaaagggattttaaagaatgtgtggataagtgtgacagtcttcagccaaacaaactgattcccagcagtcaaagacaagtactcaagcactgcagggccatgaggaccttgagaaaaaggaaaggtggtaaggaaatcactcagagtgggccctgggtgctggccaataggtggtgctgtctgtatggacagcagtgttgtcatccagggcagcaacacagtggaaaggaaatccaaagcttaatgagccattcacatataagaacctttgccagctaagtgttcataatttgagaattacatatatttcagtattcattatatgactcaagatttcaatatttcaatattcaatctacacaactgatatggtttggctctgtgtccccacccaaatctcatttcaaattgtaatccccacatgttagaggaaaggcatggggggaggtgactggatcatggcggtggatttctctcttgctgttctcatgatagtgagtaagttctcaaaagatctgatagttttaaggtgtggcaattccccccttgctcttttactctctcttgccaccatgtaagatgtgtcttgcttctccttcaccttctgccatgattgtaagtttccccagccctgcagaactgtgagtcaattaaacctctttttctttataaattacccattctcaagtagttctttatagcactgtgaagatacaataaccaacacttatacaatacaataaccaacacttaactagtattaatgatatacccctattaagcaaaaggatttcttgagtgaagtaaacccaataaccagtatttcttttcaaaaacatctataaaaatactaggtttctataaaattttccagataccacttgatagtcattcaattgaacattgaatatgctttgtctcaatttccaacattcaagataaatattttttctattttattacctttttcattttatcattaaaattattatatcatattttttcatttttaaagagagagtatttcagtaactttataaattaagtaagtttttgctggccaatttggaaaactaaacaactattttaaaagaggaaaacgcacaccggaatcaacaagtaaaaattgaatgtcatttttattactatttttacttataagaattatagaaatatttggttatttcaattccctatgtgtataactcatcacaatttgataaggagataggtttaagtgtatgtgtatataaaaagagactgaaaggaaaaagataagtagttatctctgattggttgttgggattagctatattttccaaatactctagaatgaatatgtattacttttctattattaattgggttagggattaaaaaaacattagacctgtatgttaaagttgaaccagcatcgtcaggaaggatacaaaaatcacctgccaaacgatgtccatttcaatttactttatgtcctttctaggaccactgtgagcagttgtaggtacctgtgagagtgctcaatgtaaaaaaaaatttctgttaccctaaattgggttaatgataagtgtctaaaggagatgtagatctagcatataagaccttctagataaatttaaagatatcaggaatgaaggctgcagaggagtactttggaaaaaaagtttagtaatgaaaagcaatatgaattgtttcagaaatactgtgacttggagacatgggaagtgtatcaaacagaagtcgaggacagacataaatgaagtgacttgctttcaatacgacagatgtccaagacggaaaaatgtcacccagggcaagaaaatgactcaggctggaataaagaaactagctgcagagagaataatttaatcaggaaatcgaagccaggtacagtcgctcacgcctgtaatcccagtgactccagagcctgaggcaggaggattgcttgaacccaggagtttgaggctgcagtgagctatgattgcaccactgcactccagcctgggcaacagagtaagacctcatctctaccaaaaacaaacaaacaaacaaacaaacaaaacccatagggaaccaagtggaagacttaggatctattgtcttcttttatctcaagctggtggaaatagctctgcatttaaaggtagaaataaggatggagcagatagacaacccaaaactaagagtcataactataaaatacctaaatacatattaattttcaccaagctaaagtgaaaaatgaaatgttcaatactatctatgctgtatttgtacgtatgggatatggtgtgtggtggatactgggctgggcccttgaaactatgaggctaataacactgagaagggaagatgggagaaaaagcagtatgggaggtcttaaagtcttggtaacttcagaaatgtgctaggatttgtgggcagcagatatttcaaaacactaagtaaagaacgctggagttaaaggcatggagcttcagaaagttattagcactgatagccaaccacggtggtgggtgcctgtagtctcagttacttgggaggctggggtgggaggattgcttgagcccaggagttcaaggctgcagtgagctatgatcatatcactgcactccagcctgggtgacggagaccccatctttaaaacaaaacaaaacaaaacaaagataagaagaaaagaaagttactggcactgagagccagacagatgcccaaagtaagagcccattaagaatttccaccatgagataactggaacagtaattttcacattaaaaatagctttcttcctgcacttaaagggatggttcgaggaagcagattctaaaggagaggtgaaaaagaagacatgctctggatgtttggagatacagctataagccaacatcctcggcaagccctgtaccaccccaatgccaccactccctgttccagtgggtagacatgggtgggagcagcatgagtgattacagttagggggctaatatcaccgtctttatttcatcatgtctccaacattctgagaaggacatagtggtcactatccctcaaccaaagaaactgatgagtgcagtaggaacctgctttggagggttcacattgggactcatcaatgtggaaggtaaaaatctgaagatacaattgaaatctagatagccttgaatggtatggacaaggagacataaaatctgcttactaaatcagaataataagatgaaaggtcaataataagcatagaaaggtcaataatggaataataatagtagaggtcatccctagaaggttgaaaacattttcaagtaaatataagaaactccttattgtacgtagtagtgcaggctggaaaaatatacttatttagttcaaatcatgtgacaggcactaggaataaagttagtccctgccctcacagggttcaaggtctaaatggaataatagatatgaaataactcaacaagtaaatagctcagctgttggaaatcaaacaaggagaagaaaagaaaaaggacatagtgctataaaagaaaatctttataaaattcaaaaccatttaaaatatgttgccattgatttccttattaacaggttttaatacctccatctttctctaatagttttcagtttattagaaacagtatgtgaactttttagattaaaaatttccagcataggtttatcacttattatatccttttattccttgaaatggatgattgtcaggcagaaatttaggacaaaggagctggaaaatattcatgagactcaggaacaaagctattactccaactgtaaggtttcattataagcacgtaaatatagttcaaagttaccacatctgtaaactcaaaaatgctgctcacttggctggatccaatcaatatttgctaaccattattttagttattcttcatatagacaggcgctttgtttcttagaagaaatcactgtccataaccaaaaaaaaacttaattgtgaaatggttttatttaaaacagtcttttctggttattgaacatttcatatgaataaattaatcttcatgcatatgatagcttatctgaaatagcttcccaattctttaaaataccaaaggcttcttttctcagaataaggcattttgccatcacgtggtttattagcagaataggaaaattaatcttattctaagcaaaagcagaaatataattagccaaaccaagaaaagtgtgacatttgcccatgaactcttcattcagataatatatctattttgggaactcatgagacagaagcaagacaaaaatatgagaagatattaggtttctctaactattgttcaaaattagaaaatggatgtggcttttatgttgactctttcaatacctatatgaagacagttaaaggatgtatgaaattaaaaagcgacatcagtgattattagtaactacttcacaggaagcaaatgggagtatcattgtagttagtggtatgtgaacgactgattgtactggtttatcttcatgctctcgcctcttctctttaactctacgcagtacatagtatgggattatctttaccacatgcccctagagattctgtttcacttcactcagaacctagaaaccacttgctccaaaacttgaaaaatattaagagctgatgtccccagactgctcctcaaccttgaactcaaaccactaagctccaggataaattcgtttaaaatgattgtgcttaaattttcatgtgggtctaaatttgctgggagagaaagtcctttgtttgtattttcgcatattgagaatatttatcatgattattacactgaagagcctaactattcatttaccccatttttaagatgtagtaaagacattttcctctgtggaggaagctattgtgcaagattttatcacgtgttggcggaaaatttgagtgtctgaattttgtttcacacatgtgttcagctttgcatgtgtatttctgtgtgtatatagaacatagaaaagagtctagattagaagataatgtactgaccacgttcaaagtgattatttcatcacgcaggtaataagcatagtactccataggaagttttttgattctctccctcctcccagcctccaccctcaagtaggccatggtgtctctttttccgctttttgtgttcatgtgttctcatggtgtatctcccacttataagtgagagcatgcagtatctggttttctgtttcttcattagtttgcttaggataatggcctctagctccatccatattgctgcaaaggacatgatctttttcttttttatggctgcttagtattctgtggtgaatatgtaccatattttctttattcagtctactactgatgggcatataggttgattccatgtctttgctattgtgaatagtgctgcaatgaacatacatgtgcatgtgtttttatggcaggatgatttacattccactgggtatatgcccaataatgggattgctgggttgaacggtaattctattttaagtttttcaaggaattgctacactacttttcacaatggctgaactaatttacattcccaccagcagtgtataagtgttacaaaagattatttatgaagacagagattatatgggagtattcttttctttagtatgttcctctttattttctagattttttgcagtgagcataccttacttcatgatgaggaaaaaaaattgttattcctccaaaatgattgagcactttgtatgtacacaatactgcaataagtgattacgggaattaaaaaaaaccttttttcttttttggagctttcaatattcacaaataagttgacgctatgtgataatatttgtattgcctgttatgtatcagatacttctcccatttaatttcacatactctatctcctttaatccaaatatagagaatacgtgtcaatccactccatgttattgtaaataatgttgacaatgcacagagacgcatattttataatagtaagttacaaacacaaggtaaaaataggcagacagaaagctatgcataaagactaaatggaaagcagtctagatagtgataatttttttctacctactaaatttactagtaggagcatgtatccttcccataatgagagaaaaaatgaacttttaatgatttttaacatatatgacagccatggaacaattctgtgctaactttggggtacttatgtgcagcatattggacatttagtgaaaagagagaccactgtgagatgatgaagctggagaaggcttcaagaagcaatgcagggctccctgagtactttaaaggaagggcaagtttctttaagaatgtggaaggaggacaaggaggacgttatagaaagaaaataacttgtacaatagcaacaagaactggtccatttataaaacaggagcttgctcaggtggtggctatgaggattaagtaagttggtgcacctggcatcatgcctggatgaaaggtgctcaggaaatattagccatcatgatgatggtgctggtgagaatggagaagagggatgaattcaagacacagtccaaaggactaaatggtaaacttgttcacagtctggttccttgaatagaaataaaagtgccaactaggccttcattgtttctctcccaagacagcagaaggagagtgcccgtgtcagaaggggaacaggctggggagctgggcagcaggggtaggtgatgagacaagtttgggacactcagagttaaaagtttgggaggtaaaggaagtgtggccagtgaggcggagaacacagaggtggcatcagagaaacaagagagggaagatttttcagggatgtcatcaactcttcagccagcggaatgcaggcggagttgaagaagtggaaagagaagtcccccagtgctatactaattgtgtcaccaattgaagcaccctgctttccctattcttgcatctaattgcagtacgctaccatgaaaccagttcattctgtgctcaatttgctgttctgcttaaagggacttaaacttgatatctgaaggccaactgctacgggccattacatttatttccttccaggcattgtatgtagataagcaattaaatgagggaaaagaagttgagagtcatttatcatggagaaaaaaaaaaaaaaaaccattgaacaaggctgtacaagcaaacctatttggattgaagaaaacataacgtttaattctcagaaacaaatgcaagcatcggtccaagtcttccttcccaaacctttgtcatttagggattgagaagctgagttgggtgaaaggttgaatagaaaacaaaaaggaaagctagaaacacgctgagctcatggagatgcagcttcttctgtagctcctaaagcccagctgaggtatcatctaatgagaattctctctatgccaggcactgcgctaagcatttcacatcattaagcaatgtgagttttaggcaaccccgaagcaggcagtctgttcatcccaattgcagctgaggaaacagggtgagtgaggccaagcagctggcccaaggtcccctgcctggtaagtggcacagcctgcagccctgccaggtggtcccgctaaccaagccggcgcttttctgtcaccatgccgtatcgcctcctgtactatcaaaatgtactatcaaatttacctcaaaagaaaaccctctgtcttctgagaagctccggaaggtccaacacgttgcctgccaacaaaaaaacatgaagagttaaaaattagctatcgtacgtaaattattagccatttacattgtatgtaaattatgtttcattaaactttaaaaattagaaaaagattttcttctggtagatttccttaaaaaagtgttacctttaagttttacacttaagtgacccatgttatctgttttaatgaataattttcctaatagaaaattattatgtggaagacgacgacggtagcgggtggcaatttaggataaaaagtgatcaagtgaactcaggacagcgaactctttctaactgtgcacaaatataactgtctattctcttcctggtggcatcaactcaaaatttcagttcattcatttattcagcaagtatttataaaccaaatgaaccatatgaaatcgccattcttgtaggttaaaaatggtcatatgtgggtaattccaaatagttcaacctaatatgaagaaccctctgtgtggtagaatagataatatcatgggagctgggaatatagtgttgcataaatggaccaaggtcctgcctttatcttgctacattctggtggtctaagacataaacaagcaaaaagatacattaacaaaattatcccaaattgtgataagaaataaacaggataaaataattaataacttacttgaggtgaattgaaagctacactgaataaagagatcagaaaaagtaaggtggatggaacatcagaggaagatcattccagacaaggggagaggcaggttgaacgtccatgaagcagattgaaactccttagcagggccctgctgagtgaggggacttgttattaggggagttcagagaagtaaatggaagtgagttttgtagggcttcaaggaccctgacaaagagtttgaattttattctaagttagaagaaagtcactgaaggctttttgcctaaagagttgacatgattcagttaatgtattaaaatataacttatggtgacgggtacagtggctcaaacctgtaatccctgctagttgggagggtgaggcaggaggtttgatcccaggagttcaagggcaacagaaggagaccttgtatcttttatatctatatctatatccatctatatcttatgggtaaaggaaatattctatatttttatcatagtggttacatgactgaatttatttgtcaaaagtcactggaatgtatacctaaatatgtgaattgctgcattttactctatgcaaattgtacctcaaaaaacctaaccaaaaacaaacaaatgaaaagataactctgagctgaagccattaaaaattatttatctggaaggtattggtatgtcttgtttgtttgtttccttttggtggtatcatttgttgaactctgcctgcttaaactctgcacatgtattttttttgtaaaattaaaattatattttatgaaagataactctggctactgagtggagaggaatttataagacagcaagactagagactgggagaccatttaggagactatggcaagaaatgagactatggcaagaaatagtcgtggtggtgatagtggaactgagaaatgggaataacattaaaaacataatttggaagtagaactgacaacacttactgatgggttggatgtgggcagagggggtaaagaaaaagaaatcaaggatgacttttggggtgggggtgtccacatggacaaggcatggttgaaaagagggaacaaacagttcaatgaagggtttgttttggactttaaaatatttgaggtggctatttattattcatccaagtggaggagtcaagaaggaagttggacacataggcctgcagttgaaggaagagatgaggactaaatctgtatgtcatcagtatacatacgatgtcttagtcactttgtgctgcacaatattacagactgggtaatttataaattatagacatttatttctctcagttctaagggctgggaagtccaagatcaaggcaccagcaagtttggtgtctgatgaggacctggcatcttctcactgtagcatccttacatgggagaaaggagaagaacaaaaagagcttagctagttccctccatcccttttataaggttctaattcatttatacaggcagctccctcacgacctaatcacctcctaaaggccttgcctcttgacaatgctgcattggggattgagtctcaatatgaattttgaaggggacatatacattcaaaccatttcacatggtatttaaagccttgggctggattgagatagaagaccaagggtaaagaagagggccctatagcactacaaatttggaagactagtagggaaggaggatcagccaagcagggagacccacattgtctgttccaagaggtatatacatttaaccctttgagtgttgaatctgtgaattagtcagtttggctgccataacaaaacaccatagactgggtggcttaaacaatagatattaattttttcacagctctgaagagggaagaggaagatcagggtgccagcgtggttggcttctagtgagtgcactctgtgccttgcagacagctgccttctcactgcacgctcatgtggcctttcctcggtgtttgccatagagagagctctctctctctctccgtctttttatgaggctacagtcctatagaattagggtgccacccttatgactcctgtagccttagttatctgccaagaaccctatcttcagatacaatcacactgaggattagggcttcaacgtatgagtttgccaggggaggacacaattcagttcatagtaacctgcaaggagacatatcaggggcacattcttgtcacacggccaaacttccattgcaaaatgactacattacaatggatctttatatgagtgtctagcacattgttgcaattattcgatgaactatcattttgaatttgttcagctgcacttgtggaagaggaggggtaggagatgaaaaagaagaagaagagcatcgattgtgtactcactctgtatcaagcactgttctaagtacttttgcatgcatcactacttcgtccagtttttatgataaccctttgaggtagatattttgttttacagatgaggaaacagaggccccaagaagttaaataacttgcttaagatcacagagctaatgagtggcagaacaattattctagctctgattttaagggatttacttaacttttacttggaattcatggagtcattgggctttatttaataagtatctcatcatattctagttatatcatctcctataagtgttcaaaatttgacaaaattcagatcaaaggtgttttgggggcattttggtgtcagaagccatgaggccattaaaactcatgagggctgctttagtttcctagggctgccataataaaggagcacaaactagaaagctgtacatctgaaatcaaggtgtaagcagagccgtgtttcctctgaaacctgtaggggaatccttcctctcttcttagcttctggtggttttatagcaagctttgacacgtagtgaaatctgacacaaattaagtacataagaagctgttccttggttttcagctgcataactccagtctctgtcttcatcattgcatggtcttctccttgtgtgtttctgtcttcacatggccatcttctaataaggccaccagtcatattggatcagaggcctaccctactccagtatgacctcatttttatttaactaattatatctgcaatgatcctatttccaaataaggtcacattctgagatactgggggttaggaagatatgttgaagagcatgtcttttttttcggtgggggttggggaggatacaattcaacccagaattccagacaggggctttgtggatagagtttataatcttaaggaagcacatcccttatttcatctccccttttcccaatcctaacatccacagaaaatttcctgccagcagttccttccttgggtttaaggattccccaatgccagatgttaagtctgctaggaaatctgtagaccacagggaagaaaatgcaaaaagaaaataaagtcctcaaatgcagctaaaaattgctagcttctatttttaaaataaagcaacataatactttttcttccaatttatctaccttcaaaagtcccaacaaatgttgttcgtagtactgaaatctatcatttccctttattttttccattcttcaaattgagctattaagtcaaatgctaattacatgaaacattgttctctgttaataaacgttttgagaagttctgccgcctcaaataaacaactaaaacattaagtcagtgtggcatttcagttgaatagggaaaaactagattacttaataaatggtacagcaatatttggctaaccatttgggaaaaaataaaattagatgcctacttcacaaattaaatttcagatttgttaaagatttatatataattaaattaaagacagatccttaaaattcaataaaattttaaaaattgcaaaataaaatatgtggctatttagtgtatttgggtattgggaagtcttttgactagttataaacactaagatataatctacaaagagataaatcaacttacaaaaaacttaaaacttcatggatatatagaaagcagcactataacatggaaaaaggaaagatgcatacagtatatgacaaataatatgtttatattatgcatataaaaacacttacaaataatttgcaaattaatgttccaacagaaaaatgagaaataattttaaaaggcaattcacaaaagaagaaatacaaataaccattaaacatatgaaaagatgtttctttttacttaaaaaacaaataggatctttcaggcctctttcagttctaacacactgtgattctgaatacaaaggtttcagttggaacatttttgcatagatttgcccttgaactgatcctccagtgcaaaatactttaattgctaacgtaaagtttcataaaagcacataaatctcatttattatagttctaatatgaaaatctggatctctttagaaccagctttattaggatctcttggctgcatatgtcagaatctcaactcaaactctcttatgaaaaaaattcagcagatgtctaccacctccacacattcctacatccttaatctccctgtgttttaaaactctaaatgagttctcttagaaatataaaggcaaagacacctcattcttctctcttgctgagtggagaagaattaaattctcatacttataagtcgaacagctttaagtagaatagacatggagggccagctaacctctccagcgacttcctagtaatttaacttttcagttccagaagtttctagaagaaaaccccattcctggcttaactcagcctataacctgagcctctagttgcagctcactgaagcaccataagaatagcaaccatgtgtttagaacagcaaccatacgacagcaaccatgtgtcatggcttattctcatcaagcctccaggttgtagggagcttcggtgattatatttttgtttaacagccctctcacccaccctcctcttgggttccttgggtaatcactccctctctttccatgtggtccaggcaaacctgtcaatcacaacatcttcaccaccttccccttgccaaaggcttacaacccaagccagacaatcagaatgttcctagggttggattaattgttgttaggagaaaggcacttttagccatggagcaggcaaactcaggatgagaagctgggctactggtggccaaagaaagtgatttctcacaggagaagttgaggaaagaaacagggaggcagggccagagatgatgagggagacagagaactccgtaaacaggagtaccgaagtttgttgtagccccggacttcccagatgtgtaagacaataaattctctttttgcttactagcttgaattgggtttctgtcatttaaaacctaatggctccaacttgtgggcacttctgacttacagggcagctcccacagacctcagtagctttaccagtcttccttgtcttgtgagctaccatcttctactcttttgggagtgtgcgtgcatgcttcggattatcaaatgatttcaatgacaacaaagaactgattgtagttttgttcttccaaaaattcatctttcacttccaaagaagtgagatgtattttacacacacacacacacacgcacacacgcacacacacactgcatttctgttgggtccactgattcatgaatttaccctgacactaaacattcctttccattctagttttcaatacagagccagtttcagcaagcttagaatagcaggttctttgctgaaaaaaatattttgtttcaggcaagttctgtcagttgatgattgctatattacaaattacccccaagcttaccaattttttttttttttgagacggagtctcgctctgtcgcccaggctggagcacagtggtgtgatctcggctcactgcaagctccgcctcccaggttcacaccattctcctgcctcagcctcccgagtagctgggactacaggtgcccgccaccacgcccagctaattttttgtatttttagtagagatggggtttcaccatgttatccaggatggtctcgatctcctgacctcgtgatccacccgccttggcctcccaaagtgctgggattacaggcgtgagccaccgcgcccagccaagcttaccaatttttttaaaaaacaaatgtcatctcacagtttctgtgagtcaggagtccaggagcttcttagctgggtggttctgcctcagaatctcttacaagacttcagtcaaggtgtttgccagggctgtagtcatctgcagcctcaactggggaaggatttgcttctgcactcactgccacggctgccagcagtcctcagttcctcactacgtgggcctctccacaggctgcctcacggcatggcagctggcttctccgagtgaggagtttaagagtgaaaaagtgagcacgcacctcccaagacagaagccacagtctttcaataacctaatctcaaaagtgacatttcatcctttctgccagatctatctgagtccttatgtccagcccacactaagaaaaggggaatgtagctccatctctttgggagagaagcatcaaataacttgtgaatatatctttaaaaatcaccttacaagtggtggcgctcgcttccccaaagagaatctgagttctttctaaaataccaatcctttgttaaaatgagatggagagtagatgagggaatgcagcggcaatagggaagacaactattccaggcagaagagaaatgctgtatcatccacacacattcctcaacatacctaaagctacctttaatggttttaagtaagaaaatggctgagggatttaaaaatctttactgggaattagaaagcccctagcaatacaactcagtaaactggcattaagatacagccatgcgattatcgtggatgggaaaacggcaagattgtaacaatctgcaagcatgttgattgatcagagttgcaaagtactatcagctggccgatggcatacacaaagtgcagaggagctctcaactctgtaagaagaacaatgccggaggagtagaatagctatccttagcccaggtgctcactgcccctgtcacgtatgctcatgccacacctgagataccgggagggcagcgtcttgtcctatgtcctcccattactttcattcccaaagtatttctgcctatagagctcttccggcctctaaactccttccagctgtgtccaaccttttcaatgcaaggactattttgcttatctgtggtggtggatatcatgaaaactatgcatggacctttttttttttttttttttttttttaggtcatcagctattgttagtgttagtgtattttatgtgtggcccaagacaattcttcttccaatgtggcccagtgcagccaaaaggttggacacgcctgcaatacttagtaatgtatatcattcatgtggtgataaatatattcagacgaagaataattctttttttaaaatgtaaaatcacaattatttgatgtttttcatttgtgaatgccttttacacgtagtccctacatttaggtgctttggatgcatgacttttcactagaccagtggttctcaaccttggctgcacattagaatcacctggaagtttctttccattccaagattcaacacagaaattaatagaatactgaatcaatttcaatgaactaagagtgacaatttttactaaaaaatatttacttagcaagaagccaagattgactgttgttttagagtctttctactcgaagtgtggcctatggaccaacagcattcttatcagatgataagtgagctgggagcttgtgagaaatgcagaatcccaggccccacatccaaattataatttgcattttaacaagattcctgggtgattcatacgcccattaaaatttgagaagcactcatttagactttcccattacccttctctttatcactctgaatattctccaacttcctatctagtgaccacagagggtactgacagattacagcttcaaagcataaccaggatcaatagaatacattcattctttcattccagaaaaatctatttagatgtagggccagtgcctatgcttgtgcagactgtgcaccacatctgggaagtactattcacaatgtagaaattttacatttggattttattgctacaccattttctagcagacggcagtacagtgtcttgcaacaaaatcaatacacataagctttggctgaatggaagttaagtgcttgaggaaggaatgtcttttttctattcaatggcctataggctagatgtcaccttaatgggagccaggacctggcgacacagcagcaaaccagagaggccaaattattaactatttcccatttaatacaatttgtttattagtttttatgcaaaattatggtatggtagtttttaaaaattcaacgtatgtggcatattttccttccattgcatacgatatagcctacaattttaatgtttaatatacaaaacacagcttgtgtttttttcccttcacaaagtttataacaaatcttggagcacaatctgtaattacaatacatcgtatgcagaaattccagccactttcgagctttatactttatggtgtagtttccaagtacacgttatagcagaagtgaaagaaaaactctatttttctgaatattctataattcctgtcatcaagtgccttggatgtggacattagagatcagtcaatatttgttttaaaacagtattttcaacttcttttatatacttttctgtctctctctctctctctttctttttttccctaatggaatgctctgtcctgcttgccagttttggtgcagagaagccaacaaagatttataaatagggatgctcatgacatcatgatttatgacaggtaaaaacaggaagcattttagatttcaaacaaaaggtagttgatcaaatatatcactacacatccaagtaactaaatagcacatttattaaaaacgatgagtctaaagaataattaatatcatagggaaaacatttatgtaaaatgttaagcaaaaagttttaagaggttaaaaggaaaaaaaaaatcagggtgcaaaaccacatacatagtgtaatctgaatgtccctggctccttgctacttagctagtctacggactagcatcatagcatcaccaggagcttgttggaaatgcaagattttaggctccaccctaaaacccactgaatcggaatcttcaggtgattcttaggcactcgaaagtctgagaagtatcacccaggccgtatcaacttcggggaacagtggtcagtttacttctacaatttgaaccaaagttcattagctcattagcaccgacctacctaatgcaggaccacagtccccctccaagacacatccagtgtcttaggcaggtatctataagtataaactcaggcactggggtggtggccttacctgtctctcaaaatccccaagggggaaatgctgtttgatacaaatgattatttgaaaattatgtcaaagaaagggggatctatttcttttgccctggcaatccctcattaaatatgccttttatgtcatctctgcccattcgttttcctttcggcttcctcctatccctcacacatgcctctcctctcttacctgagaatcctgagagagtcgaggaggaaacctggtattccagagttaggagaaacgactgtgccctcatgtaccatgatggatactatcacagaaagcaacatgcatgctctcccaccatccacactgggacgtgagcatcactatccctttatcatcccaatggccactttgctgcagcaccaaccttgctgatgtgacccattctggtccactgctggttaaaaactcccctctgaccactgcccacatggttggatcagtccaccgtggacccaagatgtgactctcactgctttacactgccatgtgggactctataaggtcactactctcctgataggcatgtgggatctgcagtgtgggatcccccatgcctaccgagaaggagaaatgggggaggatataggtttaagtagaaattagacaagggattgggactagagaacatttctcctgagagttttcaaggaaaatgacttgcctggttatgttcaagcataaagtatataatacaatagaaaacagagtaataggagttaggaaacgtagtgtcttgtcttggttctttgtgtgaccttggggaagtcattttcagatgcttatttttccccttttggaatgctgggtaaaaataattgcacagtccatctcccaattctggttaagttcaaatgagatgatgtttggaaatgagctttgaaatcccttaggtgtagcattagcaccattaatatgcagcaccatggtaagaaaaaaagacagtctgttctttaaattggcctcaagaaaatttcacacctggatatctggtggaacctgcaaattggtgttgtatattttaaagtcaagagtaaccttggagactggtctagattgaaaatcaacagtacattggagagtgatacacagctcctagctggtaggggaaattgagggcatccagagtgaataaagtgtttattgcggtggagtgagcaggggggagtagcattatgttctaaaaacattcaataaaagaatagccaccttccgttttctcaaacatctatgcaggtgcttagatcccaaatatggaagattttgcatttcacaaggtatctttcattctacatagatttgtagcaaaataaaaatcattatacattttaatggctttgttgatttggttaaattagctgaaggcattgttgactgcacataaaatccatttctcaaagttctttagctttttgaccctttcatcaattcttcttcagttctgtcatcattctttccctcctctttcaatttcctatctaaaatgttccaaaataattataaaagtcagagaggcatgatgaacctttttattggaaagagatgaaccttccaaactcattctcagctcatcatcacagcatttggaatatggagtaaaaattcatattttgcaagtgccttggtgcttaagcatgcagaacagatgtttcatttcacaagttttcccaatttattacacataatatctctatttctgtgagacaaacactgctttggggaataggcctctccatttcctccagcaagctaaggcatggaaatggactgttgagtcaccttctagtcacctcaggagaggagatttttcaaatgctgtttgtttattttcatgcaaggtcatcaaggggaaatagtcacagtcccatactccttaccaaaggccgtcacttctgcacatggcatttctctacctgaaatgcattcaattaaatgcactcatccttgctaggcctggcttgatttcacatctgtgacggattccttgatgaactcgacaccgagtggtttcttccaatagctaaataatacctgatgatgacattattttcatcattaccattagcaacttaggagggagaaaggtggtgttgggcagggaagtcacactaacctcacctttccctgttgcactctaaattccgagggcggggtggcttgcacagtgcctttcatatgattggtgttttaaaaacattgcttggttgattacataggatagtattgctgctttggtagcctaactttgctcctacactacggccagaagagagggtgaagaagaaataagaaaataaaaatcaatcctaaagaaagtggtaaggagcaaaataggagttatcggggaagcacaaaaacctgaagcagataaccctcaggcgtgaaggcctatttctctcctggtttacacacgcacccacctccgtttctctcctacttctccgccaccccacctcaaccaggaggcaattccccaaccaaccctgaatatgtcttctaatttcatgtactcaataatacccaaaccatttaatctcagtcactgctggtgggagcggcaattgacacgaccttgaagggaaagcaacttggcagcagatatcaagagttctaaaaaacatttatactcatcttctccataattccacttctgagctgtatcctaatttttaaaatcttaaatatgtacaaagatttatgcccccagagtttccaatacaggtttatttatacagagataggaacagtgcagcagtctagcatcagaaggagtggctaaattatgggatgagtctctcactggaatttttctaaagttattttaaattatgtcttaaaggcatttaaagcttattttatttttaaatgtttttaaattagcatgcaataaaattgacctttgtctacacagttctatgaatttcagcactcacatagggtcaggaccgagtttcctctcacaagactcctagccccaccttgaaatcaccggacgcgcttcgttgtccaggagccttctcgaagcggcgggacgtctccggaggttgggtggcccggtcagtccgcggcacacaaggacctctagggggcagtgttgtctcacaccacatgttcctctaccgggctttaacacacacccttaaactctaacccagccaaagcactattgcgtctgtattttccaaatactttacaatgagtatgcactactattacaatcagaaaaaaaatattagattactaataagctattgaaactgggggagatagcaatataaaaatacccactcatggaagacactgcttaaaatagagaactagcctctgttcatagtctggtttcaaagcccaaagttacgtttccttttgttagattgctagatgatatggctctggactttaattctccatgtttaaaatagcatttctgtatttaaaatagcatttcaatagcacttttaaaacttctaaaatcatttctgtaatactcttttttcagtgagaaatagaacaatgcttcttccctctctattttagagatagcaaagcgctaaagagatgaatttgtgttagaacatctatatattaattcagaatatcctaataagcaaaaggatattgctaacaatttgtatgcagcaaggcataagttttggagtcttctcaatttagctattccacttatgctagttcacccactcccttcctgtgacgggttccctagtgatgaatggggcatgtagattatcagatgagtggacaggaaggaagacagtctagagtggaagataaagataaccaacccatgatggaaccaactcagaaatcaaccccaccaagagaaaactttattcatgcactgaatatttatggaacacctttcacttgccaagcactgttccaggtgctggggatatagcagaaaactgcacgtcaaaattgctgctctcataaagttcacattctgggactctaacccagccaaagcactattgcgtctgtattttccaaatactttacaatgagtatgcactactattacaatcagaaaaaaatattagattactaacaagctattgaaagtgtctcccactgggtgggagacagctaggaaaaagaaataaagaggaaaaatatcctcttgaaagttaaaataggatagagacggattggtgggggctactttagactgcggagtcacagaggacctctttgaggaagtggtaatttaagatgagatcagaataacatatccagccttgagaagacaagggggtggagggagtgttccagggaaaggagacaccttatacaaaggctggaacaaattgaatgggttcagaaaacaaaaggaaggcccagagtgactggagcgtggcatttagggatgaaggtcaagtcagaaaagtatgtaagagtctggtcaagtaacagtctcgtaggccaaggtaaggaatttgggttttattttactgcagtgagagatataggagatttcacacagaggcgtgaaatggtctgatataggtttctaagaaccattctgatggccattagaaagtgcaagtttgggaatatggcgatcactgagaaagctatgggaccgtgcatggtagatcatgcctgtaatctcagcacttcggaaggccaaggcaggaggattgcttgaggccaggagttcaagaccagcctgggcaacacagtgagacctcatcgctacaaaaaataaaaacataagccaagtgtggtggcatgtgcctgtagtcccagctactcaggaggttaaggcaggaggattgcttgagcccaggagttcaagactgcagtgagctatgattgcaccactgcactccagccagagcagcagagtgagaccatgtctcatataaaataaaataataaaattcaaataataaaataaaacagaaagctatcacaataactgaggtcaggtgtgatgaagtgtggaccaggattatggcggtagagatggaaggtagctcacagagtcatgacatcttttggagaaggagctgttggaattagctgtattattagatgtacatggttggggggagatgaatcaaagcacgattcctagctttttagtttgaacaactgaaaggatggtagctccatttccggagatgagaggactgaggagatcatgatccggggggaatatttggtctttaacatgtgagcccattggacgagcatttgggtaacttcagtcttactcctcagcagctgctgttggcagggtgtggtcaggtaggctggcactgtgtctgagcaagccagctctggtctgataacagagttttatctggaaggggaaacccagggctgggcttacgatctaaggtcagcagcctgtcacaccaagaaataaacatctgttaaggcaattggtacataagcactcagaaagtgtagcttgtcaaagtggcttaattccaactaggttgttattactcagttgacacctcttgggagagttttttgatattttctttaactctttagtgttatactttatgtatattcacatgaattgaaaacaggttcagttaaaagggtaattaaaaatataaaacattttttaaaaaagaaaacagggccaggcacggtggctcacgcctgtaatcccagcactttgggaggccgaggtgggcacatcatgaggtcaggagatcgagaccatcctggctaacacggtgaaacctcgtctctactaaaaatacaaaaaattagctaggcgtgatggtgggtgcctatagttgcagctactcgggaggctgaggcaggagaatggcatgaacccaggaggaggaaggagcttgcagtgagccgagatggcgccactgcactccagcctgggcgacagagtgagacactgtctcaaaaaaaaaaaaaaaagaaaacaggtacatgatgtagactctacattttaatgtaatgtttcattaattgtaatgaaacattacaatgtttcaacatccttgaaatttaaataagggaagctttgggtttccataaagagaacacttatacttaaacacaagaaggctgagacaaaggttaaaaaatggtaaagctgtaaagggctgttaaaagcataatgctgtatttttcatcccccaaatcttaaaatgtaaaaaaatggctttagcttttgactccaaagctggagattaattttttaatttttaatttttgtgggtacatagtagatgtatatatttatggggtacatgtaatattttgatacaggcatgtaatgcataataatcacatcagggcaaaaggggtatccatcacctcaagcatttattttttgtgttacaaacaacccaagtatactcttttaattatttaaaaatgtacaataaaattatttttgactatagtcactctgttgtgctagcaaatactatatcttattcatcctttctaactattgtttgtactcatcaaccacacccacgtacccccgactcttctcctactcttcctagcctctggtaaccatccttctaactctctatctctatgagttcaattgttttaatttttagctcccacagataagtgagaacatgcgacgtttgtctttctgtgtctggtttagttcacttaacataatgatctccagttccatccatgttgttgcaaatgataggatctcattcttttttatggctgaatagtactccactgtgtatttacaacctttcctttgtccatttatctgttgatggacacttaggttgcttccaaatcttggctattgtgaatagtgctgcaataaacatgggcgtgcaaaactggagaattttgaagtaatacatttactcctacagagatcctgaataatcatagttcttgattacacccacctcctcttcattattttaagtatttttgttaattactaagttgatccttctagtaaaaaggctgccacaacttcgtttcctttggaggactgagaccttcccaccttagcaagagctttccatgttgaggtttgcagtgagagtcacattacccagagaactgaggggactgcagttatgcccttgcagatacgggaacacgagggctgaattaatgagccagagccatagacaatactgccaaaaagtcccaagttcccccgagcaaatacccaggaaggatttgtctggatatcaccttcacctcctacttagaacagggttgccctgaaagtccctccacccatcgcaggagaagaccttggagagtggctagcagaattcaggcaaattctttgtttctgcattctatttgagcagcctggccacaggccaaggaaaactctcttggagaatagacattacctgtggagaatgatttgagaaactctgatccaggaatatccaacactacagtggcctcctggggtccctactaaccggtcccctattaatctccctgccctgatttcctaccatcctctccctcactcactctgctccagccactctggccttcctcaaaaacagacagacttctaccttgaggcttttacatttgcctagaacactctctagcttgctcgtttacctgcgtcatgtcttggctttcatgccactgtttgaacaaggcccacccttattaaccccaatcaatattgcaaacttccccttcaccactcaccctcaccaccctcattattcagctctttttttaaaaaggtacctattatgttctaatacatatcactggggtatgttttatatttattgtatattgtctatctcctcccactagaacacagctccacaaagggtgaaatgtttgcctgtttcttggttgactgctgttacccctgggcctgcatcagcacctggcgtatagtagactctcaagaacagctgtcgattaaatgactgaatatagcacatctgggaaaacaaaggcttgatttggtccctgttttcaacactagctctccctcccccaggactggtcctctcctagcactgccagcctctgccagtccttagtgggacatgacctgcccttgcccacacacctactcgatcctcactcagtagtcagcatccatatcccactgtgactgacccaggcacacagtgccagcagctcgtccaaactggaaactcttcaagtctcaaagtcttttatcagtctattacttgtccctgcattctctcttctgtccccctcactgtagaccttcagacactcaccaatttcctgttccctctctcagtccctgggaagaccggcagtggggtaggacgccaatctccccagctgctcttccaggctcccctgccagaggaggcctttggtctgtgatttttctgccaattattagaaagaaataggcctgggataataaaaacaaccaaggaggaatttaaaaggttatgaaatcttttaaaattctgttttctcaattgtattttctcatttgtacttctcggctcttttttgagacgtttacatagaatcatcatctttccttatatactcccttttggaggaaaaagtactttcagagtttctcaattatgtcaaataacagaaaacatttattgaacaattactatgtgctcagcaccataatgcatttctatgaaaatgagctcatttaatcctcacaacctctcggtgaagtggatgctgtcaatcttcccatttcatggaggaaaactgaggcccagagaagttatatgactcccgagtttacacagctacctagtggaggactctaagttacaacttatctaatttgagagttcaaattttcaactgctataaaatatctctgatacatgagagaagctggaaagtgagatcataaccaccagaaaaatactacttgttagtgcctcagaagaactaccactggtgtgagtagaattacaacactggcaacccaaaagagatacgcatgtcatgttgtctgattttggagacattcttaattttcagtggcaggtgccatacatttattcattgagcaaatgttttactgagtacctttaatgtgacaaaaagcctggccactgcagaaacaggtgagcaaaagcaaacacagcccttgcattcatacaacatatatttcttcttgaaatcaagttcctggcactaggtatcaatagacttgaaaatatgcataaccagctaggtgcagtggctcacgcttgtaatcccagcactttgggaggccaaggcaggcagatctcttgaggtcaggagtttgagagaccagcctggccaacatggtgaaactgtgtctctactaaaagtacaaaaattagccaggcgaggtggcgtgtgcgtgtaattccagttacctgggaggctgaaacatgagaattgcttgaaccagaaaggcagaggtttcagtgaaccaagatcatgccactgcattccagtctgggtgacagagagactccatctcaaacaaacaaatgaacaaaaaaaaaaaaaacaagaaaatatatttagcctataaccaagaatctcatttctagaaataaaaataatctgaaacacaaattaattatacatatttatcagagcattatttgtaatagcgacaaattagaaacaactcatgtccaaccagtccaactcaatgattaccagtaggtaaatcattaggtaagttgtggtacatccacatattgaaatagtcattcataataatgttttcaaaaagttttaatattatgaacaaatgcttaaattataatgttaaaaatgagaaaagtaagctataaaacaatctgtttagtatgctttttggtacataaaataatatatatgacattatttggatatgttcgagtaagctatatgatattaacatttttataggtcaaaaggatcaaatatcaacaatttcataatggaaaaaatctgaaaacaaaaaagccaaaatattaatggtgatgatttcttggtggtggtatcatcagcaattttcactcttttccttctatttttggcattttccagttttcaacaatgtacatatatttctaataaaaacattattggaaaacaaaaagagaacaaatgttcctctttcagctactttactaaatcataatgctaaatgcagtctgactgagtacctataatccatcatgccagtaactgcagcaaatgtagcaatggcctgtaattccattttatacatactgcaatagatattcagcccagaacgatatttcaagacagcagtttctgaagcagggagttggttcagataaaatagatgccagactatcagtgcttcatagccttagagataggttgctaggacctaactcataacatttccaagaaagctgcataaacttcttattgatgatctcaattacttctaaagcatttttgagaaaaaatatttttaggaccaaaataaaagtaggttataaagtcctagctcttgaggacaatggggagagaaagattttatatgctggaaagaggggttttttttgatagattatctgaaataacatatccttcattagtcagtgctaatgaatagtcacatctgttttcatggaacaatggagaattacataattaatagtttattcttttcaaaatttaatataactgctccttttacacttacttttaactctgtaagttattctcttactgtctttatatgtaatataggatacacttgcccaaaatcttgtagaatacatgagaatatacatacactaaaatgtgtatgtacacatatatatgtatacatacacacacacacacacacacacacacacacacacacacacacacttcacagtttaatgagtgcttactatatgccaagtactatgttgagactaggtatagaccagtgagcaaaactgacatgtctcttacagcccagtagcagagacagacaaacatgcaaatatatgcaaaattattaattgtgagaaatcaaatgaaagccaagaataggacactgtaagaaagaattcggctgaaggagaattagactggagagaacttggaatctgaatcaacataggatgatgtctctaaggagaggacatttacacaggagaatgagtggaagaaaaagtctcctgggcttaagaaaagaaggtcctgactcagtgataaggagttaccagtattaagagaaggtcagtaggcccagtgttttcttgagcaaggtagagggtcatcaaatggtgtttggaagggaggcctgggccatgtgactcagaagtctacaggtcctgtggaggatttatcctaagtagaataggaatgtgctaaagtatttgaaacagggaatggcatgactagagaaacatttttaaagcattattctactgaagtattctactgggctctaatggttctactattgtattgggtgaaattctgtgatgtctggtgtttgctttaataaatattccagatataaagaaagaaaatgtgggagtgccaagggaaatgataacagataaaataaaactgtcaaaatattgaaagttgctaagactgggtgataagtacatgggaatttgttatacatctccttgtgttttggggtatgtttgaaattttttaaaataaaaagctttttttcaaaaagataaagagtgagctttggctctgagattaccagttcaattctgccacttactattaggtatgtgattttagaaaagtgatttttcttctataatctttagttttcacatgtatggaatagtgataatgacagtacatacctcataggcctgttaaatatattaatgcaataatagcagagagtttggctcatagtaaaaatctggggaatgttaactattattttagaattaactccaggcatatttattgtgtgtatatatatatatatatatatgtgtgtgtgtgtgtgtgtgtgtgtgtgtgtgtgtatatgtgtgtgtgtgtgtgtgtgtgtatatatatatatatatatatatacacacacacacacacacatatatatttgttttgttctgttttgagacagagtctcactccatcacccaggctggagtgcactggtgtgatctcagctcactgcagcctctgcctcctgggttcaagcaattctcacgcctcagcctcccaagtagctggaattacaggtgcatgccaccatgcctggttaatttttgtatttttagtagagatgggggtttcaccaggctggcctcgaactcctgaccccaagtgattctccctccttggcctcccaaagtgctggggttacaggcatgagctatcatgctctgcatatatatatgtatatgtatttaaaccattctggtgtctgtatggaaaatggatgggagcaatgaatggtgacgtaaaagatcagttaagagcaattggtgagttcagctgagtagcactggagcaatggggaaggagtgacatcgattaaggagccgctggaaaatggatggtgctgaaagccctgcaaaaaaccaagatctcctgagatagttcccaggggttcttgactcctccaacttttttttttttttttttttttttttgccatggactcctttggcagtgataaagcctataggctccttctcagaatgatgttttaagatgcataaaataaaaggcataggataacacagaaaattatcttgaaatacagttactaaaatgtttaaaaagtaattttcgatatagtaaaaagttttttaataatgtattaagtaactagatgcatatatatttcaagctatctaagtataatgtgacataaaaatattgattctttgtattagtaactgtcacagttcagtttccccagaaagcagaatctaagctggagattggcatttggggagtttgctagggaacgctcttgacatcaacatgagggaaggcaaggtggaactggtcagagaaggatgacattgagctgtgatgaagtctgagaggaagcttcagccaaccttacagaaggtctgaagattatatgacccttcagaagtgccctgaatcaaagagggccaggtgtttattacccagctgaggtggctctctgcaactgaggccatttccctggggctgccagctgagggcactctgccaacagctttcatagtagctggggtaagtcctcatttctgaaagaagatctaggtgtaacattataacatcaatcacagtgacaaatttataggttctgcaagttccactgtggcttgctgcctacattcacagttgaagaaaagactgaatttcggttagagattagtggaaatgaaaatgtaattttaaaatcctatccaaattcacaaaccccacatggaccccaggttaagaatacttgtgagtgagaatggggccccatattcagagaggctggtcaggctctgttgtttgctggaacacagtaagctgtcttctgctgtagggaaaaatgagcagattgaacctaagcattaaaataaaaaaatgagcagggaaagtgtgttttccagagcaagaatgatgcccaggaacaaagcaagtcagacaggatagagtccacagtaccagagaaaagacacagattgatgtgcagctgcctgagtctacttttgaattacagattttaatccttcatgaaaccaaacaatacctccagttcttggtgtagaaacactcctatgtctttataatgttattttctcatgtaagctagtttaagtaggtttctgctgcttacaagctgacgtatcttgttgaatacagagatactttaaaactcctcccttaacacacacatacacagaaattcttgaaatttgcaggagtttggggtgaggagcatctagcaaggaacatggagttgggaatggttgaagcattgctgctgggatctattaaggctctgagctctccatgaaagtattggctttctctttgatggcctttgctgtattggataactcacctacaaaaatgacttatttttaatgtagaactgtgataaacttcaacattttgatgattatcatgctttaaaatgagaataaagatagctattatattttttaatttgacagagtagtgcaggcaataatgaaatggtattcatctgaatagcaatctttatttttaaaatccaaaggcactcaataatgtgatctgtgcactttgctattatgatatatagcatataaaatgttaagcacgtctaacatttaattcatttcaatcataccagtctgtcaagatataataaatcaacaaaaccaacaactccctcccaaacattaattacctagtgaactactcttagcttttttatttagtcatgaaatttgaaaattacctctgaattagcatagctattcacacattattttccccaacaacaaaagaaatgccactgtaacagctgcttcgtactttttaacatgaaattgatgttagtgacagattttcaagcatgtaatttgtctcaacatgtgtgtccttttatttgtaaaaactcccaggactgaagaatgaagtttcaaaaagttatttattgtgtctcctggcagggtagaatccatggaaaacaatcaactaacagaactgtgtgatggtctataagatttggaattataccattgttatagaggggaaataaaagacatttctcctgtaccagcttctcctcccccaccacccctagtaagaagtggaaaatgaatataccaaatgaacatacttggatttgattttatgatttgatttttatgatggaacgtcttgtaaatgggagcagattcctaaaaaaattacagtgccagcccagttctaagcactgcatccccaattactttgaaaagaggctcttgtaagccaactgtgcagtcacctctgattataaggtttggaaggagtatcttccaggacctacccttagcctgattcagcagatgacaatccatttccttttaaactttttttttgcatcagaagatgcagtaagttgtaagtattacacagaatacttaggcacagaaaacacaataagtagtaagatgtgtctcttaaggggctcacaattaagtatgaaaagagattattagagaaacaaagagttaaatcttctaatagaggtggtggtagaaaggtgtgttgtaaccagtctctggtcaaaatgaaaccaatttcggctagaggaagcagggatctggttatacagaacccaaaggacttaaagttggtgaaaaaaggaagcagcaagtagagcaaagatgggttgtccaactccccttgattgcactctctccaggggagggaacaataaccccttactccttgagaccagtcaacatgtgtttgcccttgagatagctttccctagtgtctctggggagctaggaaacaacaggttagggtctttgtaattcttgcctctgccagggccttggccagagatctgggaggacaacagactcttcccctatgtgctgctagaaaactggttgtaatactgttttcttttctttctttcttaatttttttaagagacaggatctcactttgttgttcaggctgtagtgcagtggggcagttgtggcccactgcagcctcgaccccctgggctcaagtaatcttcccgcctcaggctcctgagaacctaggacaacaggtgctcactgccatgcctggcttttttttttttttttttttttttttttttaatttttggtagagacagggtctctttatgttgcccaggctggtcttgaattcctggcctcaagtgatccttctacttcagccttttaaagtgctgggattataggcatgagccaccaagcccagctgcttgtaacattcttgaaatgttgaccccactggagtgaccagcagagcttgccatgcctcccgatctgtactctttgctgtagtttagatatttgtccgcttcaaatctcatgttgaaatctgatccccagtgttggaagtcgggtttagtgggaggtgtttggatcataaggatggatccctcataaatagattaatgccctgccatggtgagagtagtgagtgagttctctattagttttcccaagagctggttttttaaaagagcccggtgcttccctctctctcttgcttcctctctcaccctgtgatttctgcacacactggctcctcttccccttttgccatgagtggaagcaacctccagcctttacctgatgtagatactggtgctgatttttgtacagcctatagaattgtgacctaaacaaacctccttttctttataaatcacccagactcagatattcctttatagtaacacaaacagattaagacacttcccacccagttgtctctcagacctcattacggttattcttcttacatgtgttccactttagctgcttgggtccccatgcttttctcaacacacaggctggtgctccttcttgcctttgcattgtcgtcccctctcctgggaacatgcctcctttagtgacctgaatggctcaccacttcacctcctgtaggtctttgctttggtgtcaccttctcagtgtggcattccctggccatcctatttgacactggccctacttctttccagagttctatctttcctgcttgattttcctctgttgtactcatccctacccacatactttgtattcctcttttttaatttgtttattgccttttttcctcctttagaccacaagctccatgaggacagaaattttgctctgctttatcccctgatctctccccagcacctagcacattgtacctggtgtataatacatttttttaagatctctccccagtacctagcacattgtacctggtgcataatacattttttttttttaagagacagggtcttgttctatcacccaggctagagtgcagtggcatgatcatagctcactgcagcctcaaactcctgggctcaagcaattctcctgccccaacctcctaagtagacgggaccacaagtgtgtgccaccatacctggctaattttttttttttttttttttgagatggagtctccgctctgttgcccaggctggagtgcagtggcatgatcttggctcactgcaagctccgcctcccgggttcatgccattctcctgcctcagcctcccgagtagctgggactacaagcgcccaccaccatgcccggctaatttttatatttttagtagagacggggtttcatcgtgttatacctggctaattttttaaaaccatctgtagatatggggtcttgccatgttgcccaggctggtctcctggcctcaagcaatcctcctgccctggcctcccaaagttctgaaattataggtgtgagccactgggcttgcctacaaatattttaaagagttaaattaaatatatatacatttcaaaacttttcctttttgtagaatatgtgccccaaacggccaatattcgaactgttttctcactatttttttgtagggtgagcttgctgatagccatatgtgctagccaatactggattttctgatgtctttattcatttaaaaattatcctttatggtgactttattactgagctctcctcttctgcttgtgtactgtgcagtctactatgggaggagtgagtccagttaaggtgcccttctttaaggggaggcctgctaagtggatcttctctagatagtgaggagaaccggtgagtgagcaatctagaccagaacacgtataatactggaggggtctttagcccagagatttacaaagaagaccaaaggatttatcagtaattaccctatctatgtaatacatgtagataaagatagataggcatgtatatgcatatatacagatacctatgtatatatctatctatatacatatatacatgtagatatatacatacctatatacatgtagaaatacagatgtagatataaatatatatatgtgtatagagatatgtgtagacatatatagatgtatacatatatagatagataggtctatatagaaaaccatctatctatatctagatagagatatgtattgatagatatctctccctatctatctctagatagattatctaatctatctgtaaaactatcttaaaaccatactaatttaaaaatcaagattcatcttaatttaaaaatcttaatttaaaagttaagaaccatctttattttgtggttcatatacaccatggaatgttaggcagccataaaagagagtgagatcaagtcctttgcaggaacatggatggagctggatggaggtctttatccttaacaaactaaggcaggaacagaaaaccaaatactgcatgttctcatttacaaatgggagctaaattatgagaacacatgaacacatagagggaaacaacagacactggggcctctgggagggtggatggtgggaggaagcagaagatcaggaaaaacaattaatgggtactaggcttaatagctgggtggtgaaataatctgcacaacaaatccctgtgacactagtttacctacataacaaacctacgcatgtgccattgacctgaaaataaaagttaaaaaaattattaaaaatatgtcagtaaaagtctttaaccaacaccaaatggttcatcccaagagtcatcttaatttaaaaatcttcacatcttaagaagctacatgggaggctgcggcaggagaatggcttgaacccagcaggcaggggttgcagtgaagcgagatgataacattgtactccagcccaggtgacagtgtgagactctgtctcaaaaaaaaaaaaaaaaaaaaaggagcaactttgctgcttaaattgagtataatacccatttacatttaatgtggtgaatgaaaaatttggttttcatttaccaccctacaactgaatttttaattcctccacatattctatttgcctttctcaactattattttatagataaaaggacttacagaaagcaaatacatgactcaatattccaataaaagtgctttttaaatttatattgagcattttatccttctttcttaaaaatcttaagctacacacattacatagctaggcaccgataagaatctagtactagataaccatttcaaaggcatggatagaatgctttccaggtatggattgtttccataactccccttccatacattttaaagccattgcataaaaaataaggaattttgtagagaggagtgagtttatatcctttaatattttctcactttagaagtgcagtcttggaatgatataaactctgtaaacagactatcatgctacatttacagagaattatatcaaggtgtctatttctaagacaagaataaaaattatgtttttttctaataatagaaatggataagcagaattctggcttctaataatgagaacatactatcccctagtttgaaataagttagataatttaactttctcatgttatcttgaagttaatacatcatttatattgaatatatcagtgcactacatgaagttgtacattgggtaccatcccttttatcttccacataaagtgatttagtgttttaatacacttctttccatatcctgcagttttgcatagcaaaagaagcatgcactttgaggaaaatgtaccttttaattttctgtattttaaatattatgggtacaaaatatttgtatataattatggagtacatgtgatgtttcaatacctcctttttgatcccagatctttcctgaattttttgtccaatttgtattgcgttatttatgtttgaaaaggagtaatgatgtttagtatatactgttataaaataactgattcgaaggatgtaaagtatctgatactatgtccaaatatgatttttaagcaaatgttcctaacaatacataaataataacatggaataataaaataacatggaataaaataaattcatatagctttatgattaataattttacctaaattaaaaagtgttatgtgcaaatagatggtatacgacacttggcatgtaataatgcaattaagtccaattgaatatattgcttgatttatttccacaatctttgatacatgtattgtatatccaaacatcaaaaaccataagcagcctgtataatgccttttttattctctgtaaagtttttaatataaatatataaaagagcatcttaaattatttaaataagtcaattattttatatgtggatttggtattagaacatatatcttcttttgcacaataaacttttttaagtgtcagaaattatataattatatagtgacttttgttcacaaggtagttagttgtacgtacctacaagatacttgaaaaatatttttgccgagattggatgcatttttctcttatagactcttaaaaatgttaacaagccaacacatgaacgtactgaagtattttttaatcatcttttctagtgttgataatgagttggctgatataaagtcattagagtggcaattcaacaaatattttctatggcataacaaatgtcattaacttgctagtctgtcatgatgttgcaaagctaaagtcacattcattagtgttttttgttgttgttgctgtagtggtggtttgttttgttacatgaagtggcccacttcttgtattaaattatttattctttctgaaaatgttcaatcagaatgtaataacacctttaaaaatgatttaaaaatgtattcccataggtgggaattgagcaatgagaacacttggacacagggtggggaacatcacaccccagggcctgtcggggggtggggggcagggggagggatagcattaggagaaataactaatgtaaatgatgagttaatgggtgcagcaaaccaacatggcatgtgtataccaatgtaacaaacctgcatgttgtgcacatgtatcctagaacttaaagtatattaaaaaatatatatatttatttctactgaacacaatgtctatatattagatgacctagaactggtagggggttctaatccaggggattgttgataaactcagacaacttctataatttttacattgttactcttaaagtcttgtcattgattgtctcaatattggaaaataacatgtcaatattcagtgtaataaactggaagaaaaaatgggccaatatcccattcaattaaagacattaaaaagagtgtgtatgtattacttctgctcacatcttaatgttcaacatgtcgtcaccaagccagatagaaccatatactggggaatgtaatgtttatctgagaaaccaaatgcctaaatacaaattttagtagtacgaagtaagaggaaataaatatgggggattttctagtcttctctattatatataaattgcaagatttggctactttaaaaaatattaacatttactaatttttcatcaattcaaatatcatattgtagagtgcaatttaatcaaattagataacagtcccaaatataacatttaactgtacatcttccagaagccaaaaaatgagaaattatttgtggcttttggctagacaaagatttcttagatgtggcccaaaagaacaacctagagaacaaacaaaaaaaccagttacaacaacaataaatatgacttcataaaaacaaaaaattctatatttctaccctatatgcctcaaactaggaatagacatttccaaattatatctgataaagaatgtgtatccaaaatatgtaaactcaattataaggaaaattacagaccaacaataaacaataaggaaaagaatatacttgaacacatactttgccagaggaaattcagagacagcaaataatcacatcaaaagatgttcaatatctttagccattagagaaatacaaattaaatgagatgccattccacacctacatatactttgccagaggaaattcagagacagcaaataatcacatcgaaagatgttcaatatctttagccattagagaaatacaaattaaatgagatgccattccacacctactagaataaatacaattaaaaatactcatcatcttttgtgttggtgatgatttagaacaactgtaattctcaaatactgatggtaggaaagtaaaatgatacagccactctgggaaaaaaaaaatggactgtttcttacaaagttaaatagacccccatcattttacctacttattctactgttgctctttaagcagaaaacagtatagcatatatacatacaagaatgtgtttgcaagtggccatgacaaacttatttataataacactaaactgtaaacaacccaaagtttatcaatgggtgaataaataaaccaaacacggtatactcataacgtgagatataaccacacacacacacacacacacacacacacacacacacacacacacaaccatattttcaacaaacggtactggaacaattggacatccacatccaaaaaaaaagaatctagacactgtgtttacacaatgtacaagaatggataatagatttaaacataaaaatgtgagactatagaagaatgttataagttgaatttaataaaaattaaaacttctgctctaagaaagtcatagttaatatttaaaaaacaagccaagactgggagacaatatttacaaaacatgtatccaataaagaactggtatgagcactccacagaactcttaaaactcaaaaagaaaaaaaaaagataaataatccagttaaaaaatggacaggagatctgaacagacatttcaccgaggaaaatatattgatggcaaataagcgaatgaagtatgctcaacatcatgtattattagagaatcgctcattcgaacgagataccaccgcatgcctactaaaatggctaaaatccagaacactgaaaacactaaattgtgttgaagataaagagcaagggaaactctcatttattgcttgtgggaatgcaaaatggcacagccacgttagaagatagctttgcagtttcttacaaagttaaatgtagtcttaccacatggactagtaacttcactcctatccaaatgagtcaaaaaaacttcactcctatccaaatgagtcacatgactccttaaaatagcttttctcataacaaaacttggtagctaccagatgcccccaacaggtgagtaatggttcaataaactggcatacctataaaatgggatattcagtgatttaaaaataagctatcaaaccatacaaaacatgcaagaacctaaaatgcatacaacttagtgaaagaagctaatctgaaaaggctgtacactgtataattccaatgatacaacattcttaaaaaggggaaaactgtaaaaagatcagaatttccagtagtctccaagggaagggatgaataaatcaagcacagaaatttttaagaaagtaaaactattcttataatattgtagtagtggttacatgacatatgcatttgtccaaacgcatgaaatgtataatgtcaagagtgaaccctaatataaaactaatgtatggactttcatttataatatgtcaatattgatgcatcaattataacgaatgtaccacactaatccaagatattaatcataaagaatatggagagtagaagaaagtgtatggaaattctctctgctttgttagtttctactataaacgtaaaattgttctaaaaataaaatctattaattaaaaaaagaatgaactattgctaccagtatcaacataggcgaaagtcagagtagttatgttgagtgcaaaagacagacaaaaaagaatagattttgtgactccatttacataaaattctaccaagtgtaaaccattctgtagtatcagaaatagattagtagttgcatggagattgagtagggaagaggggaagaagcgattactaaagacacaaaataacttcagggaagtgaatatgttcatgatcttgattgccatggtgttttctcgtgtaccaatatgccaaaactttaaaaatacactggatatgttcagtttatgtcaattacacttcaatgaaaaacattttaaaatattatgtatcttgattttatgcttatgcagagatattatttctctgcataaaaaaggtatatatgcatatatgccatatataccttttggcatagtgtaaagatatataaacatagtatataaatatggtatttgtaatattcttattcatatgcaaaatatagtttacttttaattttttaacttttcttctgtttttattccgtatcctccagacattaacactgagaacttcatatacaattacatatttaaaaatgagtcatgtctagtataatacaaaatatcagcaatgtaacgtgacaggaacaaaatataaatgaagttgctttgtatagattcatttttctcattaaaacatttcatagcataatgcacttattcaaaagtattaacatatatatttaagtgcactatgaaaaacagaatcaagaaatggataccatattgatactaaatcctatgttaaagtatgttgaataattcgtagtttttcaaaagtaactcagtcatgtcacatattaataatgaatatatttatttttaggaactccttttaaataactattaggtatatagttttatgctgagttttatgagaaacacaataagcatatcattttatgtcaggaatagagagtatatttgtccctaggtcattttctatagctgtcaaaatgtttcaacatcttttagaactccagaaaatgaggaagaaatatagaaatgttcctaggttgttcttgtaactttatctagtttttttctattcttaattatattaattcttcccaatggcttatttaaaaatgggtcttcaattgtctttcattaaaattctatggggtctcattacgtgtaagaaggttttatttcacaccaagtatttttctgttatgtaaaaggaaaataaagctctgggctaaagaaataacttttttaaaaaattttccctattgggaagtagttgaatatatactttgctgttttcagctaaaacatattagaatgtgattctatttacaacaaaaatgaaataaggctgtgttacattggcaagctgtaatgggaaatgtatttgtcaccctaggcaaactgaaagggcagatatattgaattcagtaatgctgaataattaagccctcacttataacccttatattagagaattcaacttaataagttaagtcattttccaagtgtttgttaatgtatcaaaaggatttatacatttcacaaagggggactcaagctaagctaaagatttataaacacaaccaattcactagagaaataattttaaccgtgtttttcttgtttttccaaaccttactctttcatggaaaaaaataaaggcaatattataaaatagatgaaagtgcagggtaattaccttgcattgagaagcctagagctcacctgatccacaatatttgataatccatgtcacccctggtttacttccacagttcccttgaagattgaagagctgtctgaataccacagtcttagtatactatgttttgtaaggaaacctgcccactcaagaataccttctatgagagccaacccattcagcatgttaggaagtttgcttccatgtatgattcaagcccacctggtccagtggattggacaatgaatgaacgcttgatttaggtggaagttatccatttattggttggaaatcaataagcctctttcacttgagaattctaattgagatgaaggttataataatgatgcatactggatgcacaaagccatatagcctccataatgttataaagaataatattattgatccacaggcaagcaatggagatacaaagagtacaagagtaagaaaataaatgttgccctggagtgagagaaattgataaaaagccactgccttgatgttggacaggttcttagttctatgttcagcctttattttctgcccttggattctacactgtacatttcaagtttttttacaaaatggttttgactacagaaaaagcaagtgtgccattatcccatttttgacatattttgggagaaataaagtaaaaactatttttttaatatttatttatttatttatttatttatttatttatttatttattttttgagatggaatttcgctcttgttgcccaggctggagtgcaatggcgcaatattggctcactgcaacctccgtctcccgagttcaagcgattctcctgcctcaacctctcaagtagctgggagtacaggtgtgtgccaccacacccagctaatttttgtatttttaatagaggtggggtttcaccttgttggccaggctggtctcgaactccagatctcaggtgatccacccacctcggcctcccaaagtgcttggattacaggctccagccaccgcacccggccgtaaaaagcattaagagagtttttcagagtagtttctgagttacatgtaaaaacaagataaaaaaatttactaatagctctgcagctttcaaaattaagcagtcagatttctgtgtggctgagaattgctagcagtctcctccgttagaatttgccatgcccaaaatgtcccatgctatacagttaaatgattaatgtttgagtaatattcagtttgaaatttaaatttttcctcttgaggggaaaacatgcttagcctttcattataaaattatccaagctttcctctcatttctatgttcaaattcattgcatgagttaaagcatcttaaggcttccttctaaacaatttatatatttgccctacgatttcaactagtcctaatctcagaggatcacttcactggaaaagttgtgcaaaagtaaaacgaaatggagattaactatactaaattgtcatgttgagcttcgtgataaatttagttacaaagatattattcaaattggaattaactgcaaatctccccccaatgaaagtggagtgaaattggccgggtgcggtggctcacgcctgtaatcccagcactttgggaggccgaggcgggcggatcacaaggtcaggagatcgagaccatattggctaacacggtgaaaccccatctctactaaaaatacaaaaaattagccgggcgcggtggcgggtgcctgtagtcccagctactcaggaggctgaggcaggagaatggcgtgaacccaggaggcggagcttgcagtgagcccgagatcgcaccactgcactccagcctgggccacagagggagactccgtctcaaaaaaaaaaaaaaagaaagtggagtgaaattactatataaacctagagttatgaacatcagaaaacatgatatagcaataaagtaatttaatgttgacttagggagtcataaatcagatattttattcaacgaactctgatttttaattataacgtaagaattataaattagtatctaaaagtcattgtttcttaataaataatgagttgacaaaaataatagttgaaaaataaaattatataggatggttatattgtgaaaatttccattaaaaattaaaataataaaaaaatcgcctttggaaactacttttatttaaaatatcaggaatccagaaaattgcaacttttcttgatctacataatcatttttacatgaaattttaattccataaccattgcaaagatttttcttaataaacacagtattaagtatcaaacaccttctgtgaaagtacaatagaacacaaacatatactagagatattgttttctgcatttatgcatgaacaataagattttttaaatttttgacttatctgtggaaatatgatagagaattgtatggtatggtttaagtattattcatttctgcacttagatgaggtaattttttcttttctagataaactctaattccactttttccatacagtacacacatatacatgcatatatatgtttctgttaaacaacagtagtgagattttaacaaatgacttacctgtctttctgaaaagtgtcttgtctgttaatgtcatatgagcctgtaagggaagaaagggactatattacaaaggaacagaaatgatccaggagagtatgaatacaactggattctaagaatactgggctattgggtattgggatatagattgggataaaagagtatacccctatcagagcactgtcagtttcactactgatatggtacaaacacataacaggatggttcgtagcatcaaggaaaaagtgatggcctcaggtgaggttgcaatgtcaaatttcccatggaagatgacagaagatgcatatatcacaaagaaaataatatgtagaatagttaaaatctactctcaataatttttaagttattttaaattatatgctattgttattaactatagtcactatttccatagtcactacaactacaatcactatagatctattacataatgtacaatagatctctgaaacttatttctcctgtcaactgaaattttgtttcctttgaccaacattgagatagcaacttttatcacaatttaaaaattataataacataaaacaatgtaattttataacaaggaaaaggcatttcttgaaagttaattcacaaaattgaatgaatgaattgctaaacaaaacgatgtcaacaaccagaacaactctagatatctcaggcagaatgaattcaaagaaaacgactgcacatatttcttctcaacattagattcacaatggaatcacctggggcaatttttttttaaagaaacgaatgcctacatatcatgtccagactctgatttatttgttattaaatatggcctggacatcactctactcctgacgtccctgctcaagaatcaacttccgggaagagagactgggactcactgattttggtgctattcagttgaactatgcccttactgattttccacctgctggttctattcattattgatagagaggtgttaacacctccaattatcatagtggatttatctgtctgttcctgcagttctatctgttttcacctcatgtgttttgacagcctgttacatgcaaacacattaaggattgttacgttttcttggaaaattaaatcctttgttactatgtaatacccctttgtatccccctataattgttctttctctgaagtctttttgttggaaattaatatattaatccagctttcttttaattagtattatcatgttatatatttttcaaagttaattctcaagcttgtccacaatgtgcttccagaaattaatcaactgcatattaaagttttctactccattactaactcctgtgggggctcctgggcttttgctccactaggctataattctttgcattttcccatctctctaatttaatggggatttagggtgggcgcagcagtttttctgtgacctcagtcctctaatggatctaaaatgagttgttgatagtctgtttgtacagcatttttcttgttgtaaggatgggagtgatgactttcaagtttcttacatacttgaataactgacattttttattatatactcacccctgtggtggtagaagaatgctataaattttggatccacagaactaaagtactaggagagggaatttttcacaggaaagatggttgctacagaaaaaaaaagataaagtcttctctgctatctctgctagactctctaaactcttcctgtctctggagtccagacacccaagcctccttttagttttgagctttcactatgcttttatcttaaagactttgcctactatgtcttttctgctgagaaagcaccttatcccctcaattacctggttaacatcaaatatcaaatcatgcttctgactgaaggccaagtaccacctccagaagaaatcttccctaagaacagcctacatacagttaattgtgtgatcccttttcttatatccttcgaatactcttccttcacattactcttccttcacagcctttagccagacaacacattacaggaaaacagggagaacatgattttgccattcactcttacctttgcctagcccagtgcctggcaaatgatagattctcattatatatatatatatatttgaatgaattaataaatccaagtaaagtaattgatgttttggagttatctaaggctgttaaagtcagttaaatatagttaatgtgaagcaaaaaaccgtaaacaaaattaacgtaatatacacgctgatgttactattttagaaaaaaacacaataatttacaaattcctttcaataattcaattaatgtttatgagatttgattgaagacaaatccatcacggcaatctgtgaatgctttgttgtaaataaaaggtaatccttgtaataagcaaaaacaaattaacataacaaatgtcaatttacagatagacaaaaagtgattgttttctgaatgaaaagaggattattaacagttggcataagaaatcaaaaattagttcaacaattagtcatatggaaatgtcaaatattgacaatgtgataaagaaaacaagagtttctgcaaataacctcccatccctgatgtgagtctttcacgtcattctatagttcaactagttcttaataactcaaaaacaggaaagataaaatccatcattttgttttactacccagatccctcccgtagctgtcacacagagtgtgatttatgacttgtaagttgtgctatggagcttgacaagtaagtttgatttcatttaatattttctttaaaccatcttagatcttctctttgacaagtatttcatctattagtgttctcaaaatgtaaaatgggtaacttaatgagaacaaaaattgtacccaaagatatatttgcactatctacatatttgcaattaaatcttaacagatttaattgtaatagaatctaatggttttcctcttgaatttctttagacaccagaaatttttattactaataaataatgtttagcttcctagtcacaaaccaaacagaaagcaaatttcatcagagtttagaatggttaaaaccaacatagctgcaatatttttagttttgctttaaaattttgtttaatcaaacagtaaatcaatcagagttgatcattatgtaatccacagaccttgaaataacagagatatatttctccgcagatcaatatctatatatgtttttaagataagtagaaattcccctgaagatcataaagaaaaagtatgtcatataatatagttaaaaaaatagttattaattttttctgcttatgatgttccagaatctgtactaagcattttagaggattattttatttagttcccacaataatcccttgagaaatatactacaataatcatctttaattcacagttattgaaaatgagacacaaagaggttaagaattttgtccaaggtcaggcagctagcatgacttagcaagggtgtaattaagaaaaaatatgtttttcttatcttatgggaaatttggaaaagcaaatatctacattctctttttaataaaaaaaataaaatataaaatgtgagtctctcttaaagcagggaatcaactttaattaaattgaaacaatacataatcctttgttgttcaggttctgtattattattatctctgctgacagcaaaagctaagaatagaaaatatttctgacccaagttggcaaattatgaatcaacctgctaaagaatcagaataaactaacaagtggaattaaatatgattattctatattatatgtataatataaaaatttcttattgttataattttactaagattctaccagtttcaactaaattatcttttaaatccaagcttaataaaagaaattggcatgagatgttttcataggaaatagtgacaattcatattatttttaattaagtgcaaatgagatacattatttctgtatttcattttccttctaaaagtcatctttaaagttttagtttttctgaagttgacagctattactaactcttttgggccaagttttttgagatagattaatttataaaattaggaagaaactaaagtagttgcaaaagtttctaaaaagataataaagtagttgtctctatgttataatagaaaatgagaatgtgaatgcagatcattttgactgtttgtgttttcagcaaatattacctgaatattgatatataaattagaattccccaaaggaaaacattttaaaatgttaaaattaataaaatcattaacttacatacttgtccttagtatcaggacaatctccagtggattcaacagagcatctgcagttttgttgaacaaaggtttctgcaatatagacttatggtgtgagcttactgggtcacattctttgttccttcttggagctttgggaggcttttataaaagagctgctgcagtagaaggactgagttgtgtcacactgaggatttaagtttctatgggagaatcaaattcactttagtatagggatttagtgggtttccctagccttattaataaaatactaatacgacattaaaaatgcatactttgtcttacaataatccaattaagacactatttttgcatagcaaaattctttactaaacaccagttgcaaatcaagtgaaattgcattggcaagaggtgatcatactgctctcctactcctgccctttcctcctactccagctgaaaatacttggtgcaaatgtccttttataggagactttgaccccagggtatagaaaaggaaaggaaaaggtcacatatatatatgtcttgtctataactgaaacctaataccagcacaaaagcctaaaaggaccgatttttagagggcgttggcaggaaactctttgctctgctatcatctgttttaagctacttttatacatgatttattttttcagcttctactctgctactattcaactgcaaatgcaatttgttatattgtacacttcaacaccttgaacagcatcctaattattattgaaatgtattacgagttcgtaaagaaaacagcattttgtttcttcagtcatctacttaggatgaaagtgttatttagaaaacaataaatgggaaaaatgatacattaaaaataaaaattgctattaactttttagatcaaataaaccaattttaagcattttcatggacctttataaccaaaataaacatttaaatacagataatttaattcagtattttgtttcttgaaaatattggaatatgtgttttagataatgcatatatttctgttattgaaaaataagctttcaatagtcagctgacttcatacgtaaataataataccattttaaatttattcaaggatttaggtgttcttaaatatgactttataacttattttactcccttaaagtaaatatttatggcatctgtaagtcattgtaaaattgtaaaattggtatagcatagtattcagattgtcctttgtaatgttttatactattcacatttgtatttaatcacaaatttgatacaatttagccaaaccttcaacacatttatgaagagagcactaccgagactttatacaatggaataaaataacaaaatgtgctgacagcattcttccactcaaagaggtatatatatattttttattctaattctttaattttattttttagcacccaatgatagggaaaattactggaagtgtgattaaggctattataagatacataaactgtatggcataagcattctcaactcaacttcacactctacatcgttttatcaacttagtatgccagctttttaagtttggtggaatctggtattccacacctacatgtctctgaatcccatccgtgtactgatgccaagatgaactgaaccagggatgaatttttctcttatatggaaacatgaatatattccaaactggagtgagctctcatcagcggtttgcctatggtaattactttgtgccttgtaatgggtcatgtagtatcctcataagggtgcgtctgagtcctagaccctctcccattccagtacctgtaaatatcaccttattttgaaataggagctttacagatataataaagatctcagggtgagatcatcctgaatttagagtgagtcatgggtatttgggacacagaaacacaagcaaggtcatgtgaagatagagactaaggttggagttatgctgtcacaagccaaggagtgccaggagccaacagaatctagaagaggcaaggaaggattcttccctagagccgtcagagggtgtatggctctgcctccaccttgattttggtcttctggcctctataattgagaattttttttctttttttactattttaagccacaaattttgtagcaatttcttttggcagcactaggaaactagttaatacctctattgtttggttaaacaaagaacactattaagtatttttaaaacaatgtacatcagtgttgattatggtaagcatacagtttataatcagataggtttctgtgtaaaatttcatgttattatattgatttgttttaaccatacaagacttgcttggatgtggtaccattgaataccatccccattccctcctgtcccacagctttttgaaatgtatggggctttgttctagactgaacattccttttccctcaaatttcatatgttaaagccctaccccacaatgtgacagtattgggaagtgaggcctttgagaattaattaggtttagacaaagtcatgagcatagggccctcatcaacggaattagtgtccttataagaacaggaagagagtctatagagtgctctctctctctctctttctctctctatctgctatgtgaggatacagcaagcccggaagaggaccctcaccaggaaacaaatttgctagcaccttaatcttgcactttccagcttctacaattgtgagaaatgtctgttgtgtaagcaattcagtccatgatattttgttatagaagcctggactgactgataaaggctggaacatgctggagagatggtacaaaaactaattttagaaaaatattttaagttgtaagatctgaagcaaaaatcccttacatattaccatttacatcaccaaattactccatttacagtatcaaattaaggaaatttatgttttattcaagccttttaaaatcagcacacccaccttgcagaagtaattaataacccatgattattaattatgttggccaagttaattttcatccagtattacttgcagggaaagtttgaaattgatgaatcatctcccttttgagatgtcacttgtagaactaaaggctacctataatttctgtaattgttactctttaatggaactttaaacttctaagaaaaatatttcaatatattgttaaattgacttcaatgactaagattgtggtggagaggatatttccccaaactaactctttctctgacacttaggggttcattgtaatagtaacaccttgctagcaatcatctgctagtgatttgctcatggaagaagaaggctaaggaaatttaggtttgatgacctttttcagagtttctgggaaagcaaaaccttctctctactactcactgcaaacaagcatgttgtgcaagctactgctgccaaccaggtcacatccattagtgaagtcaatgctgtggagagagacattcaaacctgggtcactgatagtatcattttcaatttctgacccaatcaattctggggcttccaattcctctctccatggtcttatgtgaaataatacattttttaaactgttgaagtcatattgagctgaaatttcccttaattacaactcttaatattttaactatttatgctaagtttctttgttccagaaaaagtactttaactcggccgggcgcggtggctcacgcctgcaagcctgtaatctcagcactttgggaagccgagacgagcggatcacgaggtcaggagatcgagaccatcctggctaacacggtgaaaccgcgtctctactaaaaaaaaaaaaaattagctgggcgcggtggcgggtgcctgtagtcccagctactccggaggctgaggcaggagaatggagtgaacccaggaggcggagcttgcagtgagccgagatcgcgccattgcactccagcctgagcgacagagcgagactgttcaaaaaaaaaaaaaaaaagtactttaactcattttcatttttgtaggacttgaattttttagggcagtttcagtttcacagaaaaattaagaggaagacatagagatttaccatatatatgtagtaatatatattatatatggtaatataccatatattactatatatatatatatatatatatatataacaagcatgtggaggcagggtatattatatatatacacacacacacacacacacacacacaccctgacataatatatatatatatatacacacacacacacacacacaacccctgacataatgtgtatatataatatatgttatatattatattatatatgtaacatatcctgcctccacatgcatggcctccttcattatcaatatcttcctccagagtggtacgactgttaaaattgcctcgcctacactaatacaattttattgcccagtggtaaatatacataacataaaaggtaccatttaatcattttcaattctaaaactcagtgatattgaatacattcacaatgttgtataattaacactgttttcataacttttctatcacatcaaacagaagttctgtaccattaagcactaattctccattccccttgccccagcctccatgccctggaaacatgcaatctgcattcccactgcatgaatttgactattcatgatctttcatataagtagaatcatatactgtttgtccttttgtgtctggcttattttatttagcataatattttcaaggtttacccatgttgtaaacatgtatcagaacatcattccctttttatggctaaataatcttcccttgtatgtacatgccacattttgtttatctacacatacaggtttgttttcactttttgactcttgtgaataagaatgagtgatggtatctggtgtgtgcatacagccattttcttactaaaggccaacagcatcaagcagtctactaatggttgttatttatctgattaggatccagagttccaaaaaggttaattcttattttttccagtttaatggcagtttttgtggagggattgacttctataacttcctattccaatcttctaaaatccactttaaaagaatggtttaaattgtgtgcttgtaagatgaaattgataaacaattattttaataactttcaaaattacatcatagagataatgtcctttgactattgggtgttcatatatttggcatgttatgaacaaccttctggaagataaaggccttttatctcatacttaatattaagacaggaaccagtgtgctagcaatggcttttgggtttgatgtgatatatttgcatgtaatgattttttaaaacttagagagaaaaatcctctcatacaaaacaaaatagtttttactgttatgagaaagtagttattaattacttataaaacatgcaagtatctttatgatatttggtgacttatttttctccagccatcttgtcttgttgttagtggggaaaaaaatggggatgctctttatctatgaaaatgtgaaaagtatatacacattttaactatacatggtttccctaaaaattcttcttctgtttttaatcctctaaaatgatcattgatatgtacaaataaatattgatgatagcaactgaaggatcatttttgctgttatcagaaattgaaaatactgtaacagtctatcaatagagaaatggttatgtacattatgatacatagcatatgtccatatttagaatacgtaccaaatgtatacaacaaagtacaatgaatacatgattatactaagatggataggcatggatccacatattactctgtttgtacatggtcttttccaaacagaaatacaatgtaagaaagaagaaaagaaaaataaagagaaagagaataaaggcgacaaaataaaatataaaccaggatgcataagctggtctcaccttagggctggaacaccagtaaagcttctcttctctggaaaaagcttaggtctctgaagttttctcagtgcatcaaaactgacagcagcaggaatatggttttgctaaaggcaacagaagagcaaaacagtctcaagatttaaatattaatccaaaggttaaactttttaccttaatgttgctactttctgtatgcacatcccacaggatgtaggaaggtggaaaggatgaaggaatgtggaaaatgtagaaaattagaaaataaggtaaatttaaaaggtaatacgactaacattcattcattcacattaagctcctaccttgtaccacattctattgtagacactgcggatatagcagtgaaaaaaagaaaataaagaaaaatatgcctttttggagcttacattctcttggaaggagatgtgtaacaacataaataattaaactatataatatgttaagtgttgctaagtgctatggaggaaagtaaagcagacaaagcaaataaagaacatgaggaggagatataattttaagtagggaaataaggaaggcatgacggagacagtagcatttgagtgaaagacttgaagaaggtgatatggtttgactgggtcccccactaaatctaaagcttgaatggtagttcccataatccccacatatcatgggagggacctggtgggagacaattgaatcatgggggcagttacccccacgctgctgttcttgtgatatgaatgaattctcatgttctctgagggttttatcagggttttttcccccattttgcttggcacttctccttgctgccaccacgtgaagaaggatgtgttgcttccccttccaccatggttgtaagtttcctgaggtctcaccagctgtgcagaactgtgactcaattaaatctctttcctttataaattacccagtctaggatatatttttattaacagcatgagaaggaactaatccaggagataaggaaacaattcagggaggaatttgaagacaggtgttttcagtcagagaaaccatgtacaaagtatctaatatgagagtgctatggtctgaatgttgacaacccccccccccattactgttgaaatgtaattcacagtatgatactattaaaagttaaggtctttggaaggtgattatgtcatgaatacagagccttcatgaaggagattggtgcctttataaaggatgcctgagggggctggtttgtcccttccaccatatgacgactccaccatgtgaagaagaagatgggtctatgaactaggaaatagggcctcatcatatatggaatatgtgagcactttgatctgggacttagcttccagaactgtgaaaaataaatttctgtcatttataagctacttagtctatggtattttgttatagctgctcgaatgggctaacacagagacaattcccagcctgcccaaatagcaccaggaagtgttgggtacagcaaacctggaacagaggcatgaggggaagagcaacagggctgtgatcaaagaggtgtgcctggtggggagcatgagtagagctatataatctgtacaataatgactcagagtggaattagaagtccttaaaagtgagtgagcagagtggcatgatctccatgatactatgttatattcttgcttgggtattgagaaaagactgaaggtgagggctaatgcagaagcaggaagggggataaaaattcagatgagacatgattttggcttggcctgggtggataacagcagtagtaaaaattatttaaatgttttgaaggtgggtttgctgagaagtaaaggatgtgtggagaaaactggattgagaattgtataaggactgtattgtatattgtatgagagtgtagatccaggatgagtcacagtatttttgaagttgtagtaaatggaatgaactagaaagatagaagttaatgttcagaaggcaggagacttaaaagttagattgtaaaaatttgcaattaggagtaataacgtggtttgagctgagatcatgagattgaatagctagatactgaagatagcaagtacattggaaatgacgaggtcaaatgtcaaagaagataagtaatttaaatgagacatcaaaataatggcagtaagtcaggttgtaaagacttcaaagaatgagggaaagtgactaaacattgggagagtgatcaatataatcaaatggtatgagattccaagctggaggggtttgaggagaaggaagtagaagtattctgcaagaggacacttattttacttctagaggcagtggttagagcgctgagggtgagaactagtctgcacttagggggagacatgagaagcagcagcatcagtgagagacagatgacaataagaatgaaaatgtaaagggaaaattgagaaacttataaaaattgagattcttctatgcactctgtacgtttcttacagaagctttcaacgcatttaatttcatttaaatcttgcaatactcttgagagatattatcattccctttttaccaaaaaaaggctgaatggccaagatcacataaaatcacataagtaatagaagtcaaaagtatgactttaacccatctagtgttataagaaccacataatcttcaataagttgaaagtatcttaattaaattaaaaaaattaataaaatttttttcaaaagatgtattcaagttatcaatgtgaagaaaaatgaacatattacttagaaacagccctggattagagtcccaattatatcacttaataattgtgtggtttaggtaagccatgtaaagttgctgtactacttaaatttaaaataaagacaattttacctaaacataaaattgttgtaatgttattgtgcagttataaatcacttattaaattataaatttatgataagtattaaacagaatacttaattttaagccataaggtcttctattagaaaaatactctaatataatgtgatacatcactcatttttataaatataaatttaattatagccttaataaaaaattttggaggtgcattaccaaggctaaatttatatttcataaaatgaacaaatttaagatgtgtaccttaactttatgtatttctgcactcatattcacaccagccatatcaagataaagaagtttcactaccacagaaaatgttgtgctgctttattccagtcgataaccactggtcaaatttgtctggaatcatatagattttatgcttttgtgtctgacctattttactcaacatgatattttggagatttatctatgctgttttatgtgtcaatattttattttgtattgctatgtattattactctgtaagtcaatatcataatttatctcttctccactttatagatgttacatccagtttttgcctacaaaaaaaacctgctgtgaataattttatatcggtctctattgtgtgaatacacaccctcatttatttttggtacatacctataaattgaatcacgatgtcactgggtatgtgtgcaggttaactttataagaaattgccaaacttctttaaaatatagctgtaaatttactctcccaccacaaatgtatgagattttctttgcttcataacctcttcaacacttgctatattcagtccccaattttctttcttaagagatggagtcttgctctatcacacaggctggagtagagtggcacaatcatagctcactgcagccttggactcctgggctcgagctatcctcccatatcggtctccaggtatttagccattttaattttaccagttctcttggatatgtaatgacatctcactgaggtttttattttcattttttctgatgaccaactatgtcatcaggagtgaaatcactgagtcataaagtcattgcctgttaaactgtttgtttgctttttaaagaaagtatcaaattgttagagaatggctttgttattttacattcccatcaaccgtgcagcagttaagtagtttctttgcagccttgctagcactcagtgttgtcattattttttattgtaactattccattgggtatatattgaaatcccattggggttttaatttttcattccctaatggctaatgatgttgacgtcttttcatgctctgattttccaaacatatattcttttcagtgaaatgtatattcatgtcttttgcccactttctaatttgactttgttcactcttaagttttgaaagttctttatatattcttgctactagtctttttcagacacatggcaagcaaaaggggaaggaaggagcacctttttactgtcaagttgagatgaaggtcaaggttccccattaggcctcctttgccacacaaaaagtaaatactctgtgtttttaagataaagtaatggatgccaagaaagactcaaattttttttatgtactaatcataaaaatgaactatgatttataattcttctcgtccattttcattatacataagttaagaaaacaaaatacatcatactcaataataagaattctgagtagaaactcaccagttcaccttagctatattttcccttttgggtttcttttacttttttttctctctctcctttttctttaaaaattttggagtgtgcagagggataagggtgagggagcgtggcaaggagaggagttcagatcaggacagggaatggaggagggcaaggagtgaagggcacaacccacagcctgggaaagagaggcatgaaacccagcgtgtcaggtggacggatcatggaatggggggccagcggaggttaaggaaggagggcccaaaggtaggggtgggaaaaagagaagaggaggaggaggaagtgcgcgtgtgaagagtgttaagaaaacgacaggacagagcggggaggggaaaagcgggccgagggacagggtgaaaggtgagaaaggagggtatgaggaaagagggtccggggcgctggggatttggggagacgatggagcgacgggtagagcagcttgggccgagccgcgggggtggaatccagacgccgggcgggggagggggcggcggggcggcgggacggtgggtgggggccaccaggcggcgccggagaccaccaaacattacagcgagcgagcctgcttcctggagggagtgcagacaaggaccaggagcgggagccgagcctcgcggcccggggcacggcgccgcccgcccctccccggcagtgcctcccgaccccctgccctccgctgggacatggcctgaggccccgcccgccgcccgggacccctcccccacgctgcccccggaccctcgccccaggaccgcggggtctcttcccggccccgccgcccgccccggcgagaacaggcccggcgggcaaggcggcggcggaccgagggaggcctggcccggcagcggggagaagggtgcggcgcagcccgagtttcccaccttttctcctggcccagacgcggctggggcggacgggatctctcgcgctctgcctcctcctcttgcttcatggagccatgcgcctgggtggaggctcccgagagaagctggcctgcgggcgggccggacgagctgcgcggacggggcggggcgaaggaggccggcaggcggaggaggaagcggcggggcggaggcggcggcggccgggaagaactagaggtattccccgggcggctggaggactgagtcgagccgggacccgagtcctccggtatcccagcagccaccggaggcagtgagataatggaggaagaatgtagggagacctccagtggaccgcactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagacatcgggggaaagccgcgagaaggccagcgtccctggctgggagcagagctagccgagtagggcgcccggctgtcaaactggccggcgcagtgcacgctgggccgccccggagcggtcgcagagcccgtcgggagtcgtagtccgggacgggcccgcggcattgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctcgcctgaccggccgcagccttggataccagccttaaatcgagccgactacggcccagccccgcccgcggcgaggtgcgcggggttcggtgccagccgctcgcccctggcggggccagcctcttgatgcaccggggacgggcgcccccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaaattttttttgaaagaaatttgggggtaaatttaattttaaatactgatttttgataacatttgatcttatgacagcatttgtatttttaattacagataggattacactaaaagtcatttctgacctgctcccttacccttatggctaaaataaactgctaggccctgaagcaaaggcgagccatgttctagagcaatgtctttcttgtattaaaatacggccccatgctcacaaaaaaaaaaaaaaaaaattttggagtgtaaacatatacatcatcttaatttgagtccttatgtgttgacggtgtgcagggaagaatgggaaagtaactgtaagtggagctcagaaagaactaacaaattcatgaaaaagtgacattattgctggtctatttttttttttaaattttctgcttcctcacactctcccatactaaatgaattatttagtgggtttttttttttgttttttttttttttgtgatacggagttttgctattgttgcccaggctggcacgatcttggctcaccgcaacctccgcctcccaagttcaagtgattctcctacctcagcctcccaagtagctgggattacaggcatgcacccccgcgcccggctaattttttctgtttttattagagacggggtttctccatggtggtcaggctggtctcaaactcccgaccttaggtgatacgcccacctcggcctcccaaagtgctgggattacaggcgtgagccaccgtgcccggccgacaggtgttttttatgagttacagactatgtgctttcagaatgaggcaaccgatttaaggatgtaagcataatttaaggatattgaaaatgatataggaataaattttgtttagtcattcatggatttattcattttcagatgactatgtgtgtgaatatttaagaattctaaaaccgcatgggattacttataactatataggagcctaacacgataatggaatcagaatatactttgctgaagggaggaggcttttaactgaaagtcttctctctacgtttttatgtctctaacaggaatccactgaagacctacatttcccggaaggttaacagcccccttctcagttttcctggtaaagtgtttttatattggtagaataccttctgtcacactctatatttttcttatctcaagtagaaaaaaattttgcccttttgcttgggactgttaacagccctggtagtggaaagtagaaggaaatgattctgtgaattttctgttatataaattttagccagtttaggacttttgaatgaggggccatacagccaaggatttaggatttcagctcaggaaagaaaactgcataggtgtttaattgtgtcctagccacttattagctgggtaactttgagcaagttttatacatatccttcccatgagtttttcatttctaatactggctgtgtaatacagtatgtttcatagacttgctgtaataatcgatggagtgtatctaatagtgtttattttactgtaactgggccacagttaggaagtactcaattaaaattagccgtcattattcctagtattaatatggtgatgaacagctaaagagcatttaaataattatcattaatatggataaattttgaccatacctgaataaatatttataatataactgttgagagtatacaagtttaatattttagggaaatacaatgtcaaattctatcaagctctattttcaaactaaaacaatagcagtttgctttcagatattttgaatattattgtgacatttcccccttctacctttctgggaccttggatacaggaaccatgtaagggtaaatcgtttaggtcttcgttgtgggacaggggtgatatactacagttccacaggggctgagccaggtttcaagggtgagatagagagctgatggtaaaaataacaatgagagcaaaggccaaaatgtatggagtatttattatgtgtcagacatttttcactaagcattctagtacaatatttcttcagatctatgaagatcttaatcttaagtagtaaatggttttattataaccactatacaaaatagaaacactaacataaaaaggttaaataatctgtttaaattatcttggattatcaacccaattagctgtgtcctcagaacagaagctggtagcactacactgaactataccacacttgcaagccttcagaggaaaattccctaagagaaaatggtatttatgactcaatatttcttcccataccctcagtgacttacgttatttatttactaaatgccaaagcagatagtccaataggaaatatgtagctaaatggcctgcgaagagaagggaatgtcaaataacaggcaaaatagaatctgacaccctaggtctcagcaagtgttttgaatggacaataaagaaagtgactagaatgtaacctctgaaaaaatgttgtgaagcaccaatggccttgaaaaaatctagggagctgatgtaaaggacatccacttcataatgacaattgttgaacaaattacttgttggagatggagttgcagacaaaacaaatatttaccactgctttaaaatacgtttattgtactcaggagaagagtctggaactgtggtttcagaatgagcttatccaacagtaagaagaggactggggcataccttttaaaataataatgatatatttataatcatcctagtgtgatttatttaccttttagtaaatcaagttctcagaaaactaaagtaaaaaaatcttaacattacatatgcaggacttaatctgaataatcataaattttcataaacttaatttacataccacaccatagtagctgtgatatagtaaattaataagttttttgtactatggtgtaactctttcatcctaagaataaaaaagattctattatgtcaaaagacatgtatctggatggttaaaaaaatccaatcatacataactgaagaaaatgtaggtattttagtggaataagaatgtgatatatgaaaacagaaaaataaatatcttcaatgttacttaaagaaacagaattaacaaagatgtatcatggaagagaggatagttctgtaaaaacacataaaataactttcaaagatgaaaattttacatatgtaaaagcatttgtcaatgaaagtaataataattccattcatgcatttgttcatgtataaccaataacttacttgtgatgccatagaaaaaattcaagcatcaaactgaaaagcagattttaataggtaagaaactagtggcctttaagctgacaatatatttgtttgaataaaaaatattattattttaaaataatcaaattagcaaaatacaaaaaaaaacatttcacatgaatatcttaatttttggtatgtgtttaaatatcaggacatttactcatattcttcataaacagagtcataagtcttagtagatgctgccatgtgtaggcgggttgtcttctctaattatcctcagtccccaccattccatagtgtccccaagtagggatattactgacatttttcatttattgccataatttagctgttgtttttcacagtcagcttgccttctttattttaatatttgtataccacataggcatctcagtgtttcactcttgctatgagacagccatagatctcttttgacctagagttttttattctctttgtttttcaaaattattttccctaaaagaatggaacctatgagcctccaaatcgtgcatttaaactcaatcacctctagaaaacaatggtaaactattcagaaagaatgaagagaataagtgaattctccaaacccagagctaatgagtgccagctctgaaaatgaagtccttgattcttgacatctggcctagtgtgcctaggaagtataatcagttactctgactcagtcattttaataattgaagtaaactacttaacagttaaacattatatacttaaaatacttaaattagcttagatataatcgaagaatttcactttttaactccaaataatgaagtgtttggttgtagggtattagatctttcatggaagaaagtagtcccgtaagtctaagtacaaatttcaaatgtaaaataaaactgatcaagccagagaccaggtttggcaaaaagtatcatttgatatgacttgtaaaatgtcaattattgtgaacaattttaaaaagacctcatcagaccatattgcatgttctcataaaggggaaaagaagtatataacagcatgtactgaatactgtatacccattatacatcgggctttttagattcattctaccatttaatttttatggacatgctggggatacggtattgttatcatccttattctttagtgagaactgagatttacaaaagaataagtaaattttccaaaattaattactgataatgtgtacacagaccatttccaaattcatgagataattgctgttttagttactttgggctgttaaaacaaattaccgtagactgggtgacttaatcagaaaacgcgtgttctcacagttctggaggctggaaaatttaagacaaaggtgcttgcacatccagtgactgatgagggcctgtttctttgtttgcacatggccattttctcattgtatactgacatggcagagactgagagagagaaagagattatctctttgatgtctcttcctgtaagagtattaatctcattcaccaactaattacttcccaagggcccaccactgaatactatcacactggggactagggtttcaccatacgaattttgaaggcacatagacattcagttttagcaactgctaacaatattactcttacacaaccatttttctcacttaaatattttcaatcaattatttaataaatggaagcagtgggattaccttggtatgaccataagaatttatctgggagatgtctatgtgtgtgtgcatgtgtgtgtgtatgtttatcgtggggaagaagtttgtgagtagaagcagtggattgagaatctggataagaaaatattctattgatcctggtgatttgaatgtacgataggagctggttgtcaactgatttaatcagtgggtatttcagtatgaggcatagttggtgactgagctttcatgtggtaatctgaggtgaatattgacatagaattagaattataactcacataaattcacacaaaaacatttttacattgcctactgatttttatacatataaccaagaaataaagtatatggtggccacctttctccagggatttatagggtaattagatgaactcttccaataattataaaaataagaactgaaataacaagtgcatattctgaattacaaaaatcattcaaagtaacaaaaagcttatatctttgatcccaataacctattttaattttctttttaaaataaaagtgttagaggcaaaaaaaaagccataactaaaccaagtacagataaaggaaataagaatgagaaacagtgtatgtgtgtgtgtatgtgtgggcatgcctataggtatagttgtgtgtgaatttaagtgaacacacttactaattgaataaaatacagtaagtgtttgtatatgtatctgcatgtttgtgtcgtattttggagttgttattcagcttttacagaatattcaaatagaaaaccaaataagattgtcacctatattgcataaataaccagagaaaagtcacttaagtggccataaaagaaatgttgaacataaatgcagagaattctatttagagtaagaatgcccacatgtattacagtccccaaaaagcaattaagcagaagaaattgctttcagagcttggaaagatttaaagtgttaccattaaagtttgagttggatgttactccatgaagagaatatatccttaaacactgctgccctgtgcatcagaacatactcactccgatattggacctgttgctggttagaaatgtcttgacaaatgggatctaattaaactaaagagcttctgcacagcaaaagaaactaccgtcagagtgaacaggcaacctacagaacgggaaaaaaattttgcaatctatccatctgacaaaggactaatatccagagtttacaaagaatttaaacaaattcacaagagaaaaacaaccccatcaaaaagtgggtgaggccgggcgcggtggctcacgcctgtaatcccagcactttgggaggccgagacgggcagatcacgaggtcaggagatcgagaccatcctggctaacacggtgaaaccccgtctctactaaaaatacaaaaattagccgggcatggtgcgcacgcctgtagtcccagctacacgggaggctgcggcaggagaatggcgtgaacccgggaggcggagcttgcagtgagtcgagatcgcgccactgcactccagcctgggcgacagagcgaaactccgtctcaaaaaaaaaaaaaaaaaaaaagtgggtgaaggaaatgaacagacacttttcaaaagaaggcatttatgtggccaaaaacgtgaaaaaaagctcatcattacagaaatggtcattacagaaatgcaaatcaaaaccacaatgagataccatctcaggccagttagaatggcaatcattaaaaactcaggaaacaacagatgccaggatgtgaagaaacaggaacacttttacactgttggtgggagtgtaaattagttcagccattgtggaagacagtgtggtgattcctcaaggatctagaactagaaataccatttgacccagtaatcccattactgggtatatacccaaaggattataaatcattcttctataaagacatatgcacatgtatgtttattgcagcactatttacaatagcaaagacttggaaccaacccaaatgcccattaatgatagactggataaagaaaatgtggcacacatacaccacggaatactatgcagccataaaaaagaatgagttcatgttctttgcagggatgtggatgaagctggaaaccatcattatcagcaaactaacacaggaacagaaaaccaaacaccacatgttctcactcagaagtgggagttgaacaatgacatgtgggcacatggagggaaacatcacacactggggcctgtcacggggtggggggcaaggggagggatagcattaagagaaatacgtaatgcagatgacaggttgatgggcagcaaaccatcatggcacatgtatacctatgtaagaagcctgcatcttctacacatgtataacttaagtatcataaaaagaaagaaatgttttcattaataatatttctcaccttttctagatataaatttaattcacagttgggcagggcatggtgcctcacacctataatccgagcactttgggagcccgaggcacgcggatcacctgaggttaggagttcaagaccagcctgggcaacatggtgaaaccccgtctctactaaaaatacaaaaattactactcgggaggctgaggtaggagagtcgcttgaacccgggagacagaggtttcagtgagcccagatcgcgccaccatactccagcctgggcaacagagcgatgctccatcttaaaaaaaaaaaaaatcaaaataaaatacaataaaaaataaaaataaaatttaattcacagttgtaaccagcctaaattaaaaatatttcttaagaaaaagattgagactttatgttttagatagttgtgtttttatgacagaatacctacacacacacacacacacacacacacacacacacacacacagacaaactaaagaactttttctgttatatatcaaatcatacttttgttagtgtgtttaattttattttatctttctgtgtgtttctctcatcaatttatctattatctgtctcttaatcaatccatccattcatccttccattcaatcttctattacttttaatatttttaaataaactgccttgttgctgtgatttgtattaatgtagactggcagagcctgaaatgacagaaagacttttatttgcatggaatctcctggaatcagctaataattcactatggactctatttactcagattaataactgtgcagaaatgtcattacctgaagagcacaaatctggggacagacagaattttaatcatgggctctgtcatgactgattggtgattttggttgcttaaataatccagactctagtctcctcaattataaaacagggaataataatggactttattatatgttaagcaacataaattgctttgggtattcaaagaagataattaattgccgtggattaggaatctgaaatagaagcttgaattcccaggagtgaaacaaatttagcaatatttgcatgactattggagaaccaggccacttaacaggtatacgtatgcccctctgactacctcctagatattttctgccacgtcagcagtaggcagaggaccagttggcttagtgtctatattgtttacatgtggcagctcaaacaatgtgatatgaatatgaactaaggagggagacacttcacacttaacatctgttcttcagtttccccaacaggatgcctccaaatgtgaaaggaaactcatcaataacaagctgagaaatgagtctaaacaactgacattttggaataacatatttgacatttgtgaggtccactggttgtggcttaatcaagaaagccatcagatatccacagtatccatcttttaggcatacacatctaaaaaacacatccatttgtcttattttaaatccatattttaacgttcaaaatattatttcatggatattttgccacacgattatgctagtttttactattttctcccctagtgtgtaaaagtacaagagaatacaaattccttggcaagtcagttatttagtcatttcaaattttgatatttccagaagtcatgaggattcttctctcacagatgtgattataaaacacatttgatttaccaacttttagacttctgttttctacaaattagctctcttgcgcaagtggagaaatagcatatgtatttggtactaagtttccctcataattgtcagaacctcaccatttattgttttgtagaaactgggatttaaaaaaaattagaccatatgataattttgatattaatactcttctgaaagactaagtgaatgaactagtcatctatattcactgattaaaaacaaaataagacaaacttattccatagtactttgggtttgtctaaaaaaatattcgtttataaatactatttctgagggacaatagcatttctctaggatacatctatgtacatgcaactgaagaaaatagcttttaaatttactttatctcttgtagtagttttatagctacataagagtattgtaatgcaaaaggtacatcataaaaactgctttgttatatgttgtgtgcatttgtatttgtgtatttacatatcgacaacgtactcactattgttcagtagcatattttatgatgaatgatgaaaccagtacaaattacatgtgaatttgacttatgaactcttcacatccactacctcataaacactacaagctagagaatgtagggacttgaatccacaaaccacagatgtcaagattaatctattacgttttgagtacttgaaactgcctgtacaattgaatttatagctgttttttaaaaaagaaaatagaaatgagaagtgctacagcaatcatactttgtgatttaaaagaaaataaatactattagttcatgcccagaaaaacaaaaacaaaaaactatgggaactttattacccttatctatactctcccacctgcaagaaaaaatgcctctcctcacaatgaataacactaggtagaggaaatatttctgcttagttttagaaggaagagaaaaaaaatttttgaaacattcatcggtaaataagaatctgaaggaaaaggcaatgtggaggaggatagggcatgacttcactgctgggagggagatgtagcctggcaggctcacagcgactttttcatagtcagagccacctacccaaaggtagaaaccaaagcaagtataaatcagaaaaataatcctcagtatattacatttaatgtcaaaacatactttgtagaatatgtgaactgcagtcttattttgagagctaatctagaattatgattatatttggaagcctgattctgtttgcctcatttggtccatttggttgtacattaaggcttgaacataaggtttgtgatataaagctgtctttaaataggctccatgacatttaaagttatctgctgggaaataatcaactttttcaaattcataatagccttgctttggggaaattagttttgatttgatgagcaaatggatcactgagatggggagtagtgatgggaagcagtcatagaaaccactagttaacacatgtcacggctaataatatcaggtattttgatgctagtgtcaatgggatccagcatgccagttaatttcaaagaaaataaacaacaacaaacactttgattgtgttatacaacctgcagtcattattttctattagctgttatctacctgtttatccattgattgattcatcagtgtgtgtatgtgtgtgtgtgcatttcagaatggaatgagtgatgaaaattatattctttcgtgcatagatatttgtagagggcctgctgtgtgccagatattaagcaattgcaattgagtaaaatagtatttaaaaactactcacagccttcaaggagcacagcgtctaactagggaactcagacaagtaaataggcaattacagtgtaggatagttctggggatcagaaaacaaaacccccaaatgaaagcctcagctgcagcctcagaaacaaacatttttctctgaccttctccagtcctcttgtctcttagttctattctcccataaggctggccatggaaactagaatctctcttccacaacagtgggtcatagtagacagaacccctagaaccccttttctccaaagccagccataaaacctatggctttactgcattttttattatgtctttatttgtaaatcccacataagtaagcgattctcatggaagcttttcttgactttggccacactcttgcatccacaaccaacttgtgctaccaagtgaacaaactatgactaaaggcctgttcttccactttgcagctgctcctatcagtgacaaatcagcgtattagaacatgcatgctggctgatcattctgatcaagtcaacaagcttcacaacttactcaatgaggtcgtccgtgagaacttcactgttttacggggacaggagctacttctttgctgaactgcatcacggtttcaactgctgaggttttcttcaagcttttgcattgtttggaatgtgaagggcatggccgagacacactttgaggttcccactgcattgttacacctcccccctcacttcagggccaggtgagcaagggaaaggagcgtggcctgggcgtcccgcagggcccccactaggaaagctatgaacgctcccgccttgagcacagccacaggcctgctctggtcacaatgtggggtcgccccacggacactggtgaccagtgggagcatgaccaggaggtgattaccttctgatcacccttggctttatttttaggtaacaccaagaaggacgccatgagagcgaaggccgttgggtcaccgccctttgctctcgcgctgcgcgtctccctgccatcaaccgccgcaactggcgctgggagcggttgagggcggccggcctcgcgctggaacctcgcccgcctcaaggctcctgcggcggcacacggggcaggccaggacccgccctaggagggccccgctggagatgtggaaatggagggacgcggcacctgggcgcttcctggggccagacaacgccccctcattggaacctccatgaccctgcctctgagaaaccagcgcgtccgcaacgatcactcctaattttcggtaatacaaacctgcagtccatgcacttaggtaacacccttgctgaaaggtttacctttggagggtttatcctaaagcaaagtatcctcaaattgcatgtcttgcattccctttggatggcattgatttcattcctgctcatgcctttcaaaaaatagtatgccctgttttcctactcagtctggaggttccattaaagagtatttctggcaaagatttttagacctgaaaacacactccaaaatatattttcttctgactccattcccagagtttttcctaccgcattcaaatgatttctagaaatgtttttgttgtagccttgatcaatttcagtcgataaagcagcagatagtaagggaacaattccacgctccccacccctgactctgcaacacagtgcagaattccagttggcaataaaaaactagtagagaaggaactcactgacttcagtttgtaataccgtcagaagaaactttaatcgtcacatcctttctgctcatttgcaggattcctatcatctgtctccacgtgataacactgaagagccttcacattgatgcaggcccagggcctcaagtgcagagactgagagctctgcaggacacagcatggagccgccattcctctactgggtggaggagcatgtgtcctctgaacaggggatccaagccctgagatgttctttctcagctgtcagtgcggcccaggactttctgtggggatgctcagacagcgggccggaggacttttagccaccacctcccatggccagtcttcacaaattacccttggctaatttgactgtctctcctcctggggtctaggacttcaaacatgtacagaagcgattgcagaattaagacaagacacttccacaatatattttttgtatcactggctcagaaaaagactcattcaaatcctgtatcaaagccacgtgtgagaatcttgagaaagcatcagctgactgacttgacaagggaggaagcaaccaaaaattctgcgcttcttcagtatctgagtatgatattttgcttcaacatccctcttagatgaagttattgattgaaaatcatttaagtttgccccatggtaaaagatcaagtcctcagaaagatctccaaagtgtttacggtttgttttgttttggtaagtttaccatgattttgcttgaattgctctccgttgatcttctcagctaagatggaggtagagagttgcacagtggaagagggctgcatgtaagaaggcagttctgtctcagaggacaaaaggcctgggagcacccagacagacagtcactgcatggaggtcactcccctcccagtggccactgtggagacatttcacagaaatgcttgctggaccattcaggttcagagttgggacaaaaccgagaactcatggggatattggacaggagttaggaaatgaccttctcacacaactggggcagtgggggagaaccctgggcttgagacttgcaatccaccacttgcccctgcccctgcccctgcagtgtggccgctgttaccttttcctgcaactctgccttcttgagtccaaatgtcttcgaaaggggcaaatgctcgtaagtgccgacagggtgtgtttcagtgaatgtttgcagtgtgcaccggtctggctgaaggcctcttcccttccccaacaccctcccatcgtgcaaaattaccctgcccagcagggagtgacttgtgtgtctcagaagattttgttgctgtgctctgagttctcactcctcatctcctttgaccagtttcttctaatactccccttgttcacaacacagaacatgagtgctctttcctatcattttgacactaataaacggacagtgattctcagtgtggaaatgagaatgaagttttttttaaagacaggctacaataattcccatgcagagaaccacatgcgatgacactggattccagacagcaagaacgtatggtgaagatgaggccaacagtgagctgagagaggccagccagggtgtgtttcagtgaagatgagaaacaatcagataacacctgtttcctccaggaaagaaaatgtggccagggaaaagagatgggaggaaggccggtcattgcctattccactgtgcacagtttgaatttggagccatgaaaagtattgcttggttaaattaaaatcattcaaaagataaaacataaatatttaacaccagcacaatatgctgggaaacaaaatgaaaggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatgtcccccacccctaacagctgcccactgcccctccccctctgcagaatgtctggggtcctatgttccaggaacctgtttactttcaaattttcctgtttcagttggactcaggagcatctggtgagccaggtcactctctgggtcttacccttggcttttctcattgtggaaactgccagacagcggtagtcagtgcccagcctgaggggatggcttcaaatggaggtaagcctgtagggatgggggcattatctgagtctgccatgcctcaactccttaggaattcaaatttgacactgccccggggacagttgatagggctgatgttgaggagggagggaagactggatgtccccaaggacatcacacctggggatggccatggcaccctgagtctgtgtttagggaggacggccccttagaggtggaacaagatgcctgggggaatacaccgtgtaggagaaaggacagagtggatggattgatcctttctagaaggagacaggtcacgtcattgtgtgtttgtagggagtggtgggatcatgttgtgctggtggccccgggaggatgataggcaagcctgaaccctgtgccatatcttcaggcacctggaaggtgcccttccatagtgttcagagagatttggactggagttttctagatcttagggaggagtggggagaagtggtctcagccagaaaactgttgggtgggttggctgtgacagagcatgtagtgacagcccctgggtgggcgaggctgggggctgctgtaactgccacagcccagagcccctcagctctctccctagagatggcttctccatcagttcaggtagctgttggctttgatttaacaggggtgggggcagatgaggaagttcaggcaacacagggcctgggtttcctgagttgttctgaattgtttgcccttttgtggaagctcaggtcttcagacccacttcctcttgtctgctagctcatggcctgtcctctgcactttgtgttactgtggagatgaagaatttgctcctattccatttatactacctcatgaacggggggcaggtgtggattcttgctggttctcagtggaagggtctggaaaggctggtttccttttcagtagaggaaggagagtagcgcacgaataggaagatggttctcttattattattattcaagttaggatacgtgtcctgaatgatgaggtgcatgtgctgtatcccttattccccttgactagagactgcatgaggtcctattgaacagggatgagttccagacaactttgcctcacccggcccatggcccaagaacccctggtttttggttggtcactatgttcagtcattgggagctcaaaggagaagggccagggatgggctccttgtcccactacctattgtaacatgaccagcagctgtgaaaatccctagacacctcccctgttagctctgctgctcgccatttgctggctgtgttctaatcgtgtgtggcttttgctggctatgcagtgacactgtctcaggggactccaccactgcctctcagacctgctccctgggaacagagcttcctgagtggcagccgggaccatcgagtactgcggaaagggtggcccgaatctgacccctatttagcacttgctgtgggtggtgccaggacaatcacttgcatgctgggcatgacagttatggattatcttcagggttcctagggcgctggcttgggaaagatttccatccagtggttttgttttgttatgtctgagctgggaaagaaaggggtttacaagagcgtcaggaaaaggaagattgaagaggagatggggccataatattcggaagcttctggcttcctgtcggccttctgagtgccgagcactgccctggggtaggcccctcacctgttgctgagcacgctgaggaccaccaagccgctgagagactcatccctgacccatggcttgggagatgcctgtgaggctgacagggtctgccagggacacccgagggagaccctcgggcagcgaaggcttggctgttacttcttgggagacaggggtcagggagtcttggtgaccggggccaggctctctagtggagcgactctccgtggaggaacagagcatccgatgcacactcagggacatttgcaagctgcagtttccctgtcatacgcccttagctgttgggactcccctctgattccccagtgactagtgtggacctggagaccccagctcattcacctctttcctttgtctccacagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaacttccccagcacacctctggtgacagaacaggatggctgcggcccgagtggggccggggcttccaacgtctttgtccagatgaggacagaggtggggcctgtgaaggccgctcaggcgcagaccttggtcttaactcagacccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatgtgagtgtcctgggggcattggagctggtcctgcagctcacacgtaaagaggctgctggatggacgggaggtcacgctgttcaggggagcttgcagggcggttgtgagggtgatgggctgcactatgggaaggtacattttcaacaatattaatctggctgcggctcaggacagactgtcaggggcctcatctcaactgcccgtcactgtctcgtgagtccagccaatccttactttcaataattttcacaacaatgtttacagaagacccaggtcagagagggttcctggtgtgacgtgagctacggtttgggtttaggtctttgagtacacaccccagtgcctcccctttaacccagtattgatggccaggagcacctcacatggggccgggggaaggagctgcagggcccagcaggaacctggcacatgcccgcagttccgctgaggtccagttagcacagcggtggtggagcctgcacagggggatggtcttgggtcctgcactggggccgatgccgggcaggtatttgcatcttcaccctcaatccctcctagaaaaagggacaatgatgcttcattcagaggatggtgaagagataacttgagctcacatatgacatgcatagcacagtgcctggcacatgctatgacacattacatgatagcagttatgattactgtccccattactatcattatcaagactaggccatctaggagagcactccccaaagccacgggctccagtgatagctctgagtgcaccatgagtccagcagcccagggccatggactgtggtgactgtgaggcagcaacgtcagcatctgggagagtttgtggtttcattcccagtccctgcctctctccaccctgcggtgcctctgtgaccctgtgtttcccgctgatgagcaaacgggagcttgagcacatccaccgtgcaacacactggccgttcccctagggaagtcccctgcctggggtgtaggtggaaggtggccccattttcatcccccaaaatctcgctgttcccgcaccctggaactggttgcattcctccttggagcggagtcccggtgcactggggaccctgattcttggggtggagctgccccaggctcacaggcctttgccatggctcctgtgggaatgtgggatctggacctgctgcttgcagtggcgtggacaccgctctgctttggttctggacgtgtgctcctgctcctcatgctccagggccctgaggctacgtccccaggggctgccttgctccagagtccccaggaagccggttaaatgctcagtcttggggccctggaacctgcactttaaccctcacccccaggtcattctgtgtgcacgctgtctcagtcagctcaggctctgccgtaacgaatgccgtagactgggtgctttatcaagacacattcatgtctcccagttccagaggccagaagtcccagatcaaggtgacagcagattgggtatctggtcagggccctcctcctggctggagagagctgtctctggctatgtctcctcgtggctgagagcaagagccctggcgtctccttctgcccttatcagggcttggattccatgactgggacccacgctcatgacctgctttaaccctgattgcctccaaatactgacacactggtgctgaggacttcagcacaggaatgttggagacacacatgttccacccatagtactgagtccacttctcaacactgaggactcgaggggcagtcggagaggccacttggtagcttgtgttgatgtttgatcttgggggtgtgtcctggggcctgaggagcccacatgggggagaacaggacagggacagatggcaggacaggtgtggggaggacaggggccaggtgttgggaccaggtgggcttgggatgaagggtgggcttatagactgagactgactgcactggtttacagcccagttctccgatccctggcccggcggaagcccaccatgaccctggaggagggactgtggcgggccatgcgggaatggcagcacacgagcaactttgaccggatgatcttctacgagatggcggaaaagtgagtctggggtcctgggagcggggcccgcgtggcagggtgagagtgaatgacagaggcccggtggccatggtggcttctcaacgtggagtatgaggagggtgtggagaaacccaggacactctgggcccctggctccctcaggaagctgctcctgccacctagagtgttctggggtctctgtcctggcctattgggaagcaccccctgcctggcctggggccatccctgccttgacactggaggtcatggcaggagcagccagcatcacagaccaaagtgggtcacctccagctgtggggatggggagaaggggcgctagtgactatggacaagagtagggtgcaggctcctcacagcagtggccagaagtcggttttctcccatcccagcctggccagggagttgggttggggagacctgcacctgggacaccatgggacccatctctggcctgactgcctttgctcctgggcagtcccctccatgaaggcagacagatagacagcagcctcaggggaaaggggccctgtcctctgagctcagcttttgcttcctcctgaccaggggtctcccaggcctcgtgcccctgggttatctttcaggggcccacagtcctagcctcaggactcctgcatctgggcatcatccctgatgccttctgccataaatcccacccctggccagctgaaacctggaggaggggtcccccgagaccctcctggacctcgtggccctgagttgagtcaggaagccccgttgatgccatgggctctgcaggggccgggtgagggagggtgagcccagaactctgggagcagctttctcctgggactgggggatgggacacagtgagggcctggacagcccacccgaggcactccctcccatccctgccctcggccgctgcctggtcctggggggagggggcctggaccctctcagcacagcctgggcctccttcaccgccaggttcctggagtttgaggctgaggaggagatgcagattcagaaatcgcaatggatgaaggggccccagtgcctgcctcctccagccacaccgaggcttgaacctcgaggacccccggcccctgaggtggtcaagcagccaggtatggcttcccacattcccacaggagccatggcaaaggccaaaggggccaagggaggccactgtccccacaccccatgcttcccttcgagagggggatttgctccctccaacaggacagtttccaggagcatatgttcggtattgacctggtcaagtttcctagctactctctcccctcgcctgtccaaaactccacatatgctctgcccaggaagcagggatgagcggggagagtacacggcatattggtggctccaaacttcctcccaagcgatgctgtctcagatgtgcccctcctgcctcctccgggggtgctgcggttcaggtggtcctgacccagctgggacccacttcacatccccaagccctgccctcccctgtgtggtgccagcaggaggagcggccctcaccacgcccgtcctcctccctctctgcctcagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtgggctggcctggagtgctggggtctgctggattccagggggtggcactcccaggtccttggaattaagctctgttccttagctactcagcagtgtgtgtatttccaaggatttgagtgtctgtgtatgtgattgtgtgtgtctgtgtgttgctgtgtgtttgtgtctgtggtttgttactgtgtgtctttgtgtgtctgtgtgggtgtgagtgtggagtgtgtacgttacctgtgtctgtgtcttttcctgtgtcatatgtgggtctgtttgtgtgtctgtgtgtggtttgtgtgtctctgtctgtgtgtgtgtagctaccaggtctgtggtctgtgtctgtagctggtggtcaccatgatatgagacagccccaggagggtggggacggggcgctcgctgctttctgcatctcctccaggtgtccttggctccaggttactccctgcccaggaagctcacgccttcttccttctgtttccaggtggaggccgtcattcatccccaattcctggaagaattgctttccccagatccacagatggatttcttggccctaagccaggagctggagcaggaggaaggactcacccttgcccaggtaccccaggggcaggagggacctggcacacaaggcccacctgattgtctaatcccccccgctggggatgctcggcttcttggggagccactctggagtgggaagatgcaggttcagagggagtaggatggacaggagccagggaggggagtcagcatgcaagctgtggtgaggcccaacgggaggcccggcagagccacaccctctctctttgacataaagcccagctgcctcaggcttccctacctgccgcctaagtgccctggtctccaccaccctgggccccgctcacacctggggcagtgcccgtaagtgccccctttcctcccgcagctagtggagaagcgcctcctacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggcctgaatggggagggcaggaagggagggtctggggggaaggggctggggagtgggggtgggaagcagtgtgttgggggcctcgtgtgtaagtgtgaataaatgtagttgtcttggaaaatgctcttggggctgctgcctctgtcctcggtgctgtgctgctccgtggagggtgtctgtgagggagggcagaggaactggcagatgccaggctctgggaacccacagaggccggccccactctttcctcctgacgtagggagccccttcagatgctccagggactgacagatgctgaggaagccctgatccctcccaccacccactcacaaggccctgcctgctttagggaggcttcttggggccccctcatcgttatcagcatccctggaaaatcctgggattggagagagctggctggctcttgttctgctcggtgggagctgaggagaaggcagccgcctgcaacatggacatggggagaggaggctgctcctgcttaaccctcatcaggaagagcgcgggcactgggctgaggggagacgttgaggtgaccatccacacaggtgtgtttgggatacgatgatgggtggggagcaggggaagtccttctgcctgtttctgggcaggagagagtcttgtccaactagctaaagcagatgctccttgctgtggccacagggactggcctcggggccctcaaggtcctgcatggagccccccacagctatgattcccttcccatatgatgactgaactcatgtggaattgatgtagacacagatttacattggtttctaaaacagttccctcccaacacaccatcaccaatgggaacaagcatgtccagtccatcaggcgcagggtgggggtttctgctggttccagggcccggaggagctggggcccaggccaagaggggccgagggtcagccgcccttctgccaggcacagaccccaagggcagagcaggggctgcctgggatgtggcattggctgtctgggaagtgccctgggagttgggggctaggtgttcgccaaagggagacttccagagtctatgagtgagatgaggactgcatcaggagagggaccgaggctggggaggatgctctgctctttcccaggttgtcctgtcttcccaatctctgctgaactgccctcaccccatgggccaactctgccccccttacccctaacccacctcttagaatctcagatcccagcgtggacaggacccggcacccaccctggttccctcctggccaacaccttcttctccacggtctgagttctgattcctcccccagggcgcttattggctcaggacccctgtgactgccagggcactggtcccagcactgcctgcgtgcagagctgtggtcacggccctgggggctggcccagcagcagaggctggtggggcaaagctgtctggtacacggtggcctggcccctcggccaagtgacaaagggagccatgtttgggtcctctctggccccatctgcccacagaacacagcagtcagcctgacagatgcccctctgccccgtcccttctgctcgatgtgggcagtgtcggaggcctgctgtcttctgtggcctttgggaaggagagtttatcttggcagggcttccccagctcagtgcacgtcaggccctcggggaaaatgtggggagcgaagagtcactggtgggtgatgtgggcagctcccgtgactcctctacattcacggccatcctcaggagataaggtagcactgcccctttgcagggtttaggaatgttaagtgagccgtgtttgaagggaacatggtccatactctggcgtgtgtgggtgcccagccaacttcctcacctaagggtgaaagtgacaccttggggctcctgctggttaccccactggctgttgtctatcccactgtccctgtccttgtcttggctgagccattcctaggaagcagaacttgtgcttcctccacctctgtgtcccacctgagccctacaatctgcccctaaatgggcacagtggggctgactggggggctctggtagactgaacatacgtcccccgcccagttcctgtgctgaagccctaacccccaacgtgatggtatttggaaatggggcctttgggagttattcagggttagaagagaccatgagggtggggccctaatgatgggattagggccctggtaagaagcagagaccccagagctctctctctccctgacacgaggacacactgagaaggcggccatctgcaagccagagagagagccctcaccagaaccttgcccactgggatgctaacctcggacttccagcctccagactgtgacaaatacatttctttttttaatatgtgccaccacccccaagtctatggccctttgtccgagcagccctatgtgactaggacaaagtccataatctcaagaacttccttcatgactggtatctggaaaccgtgcatcagagccacgggaaagaaaggctcagccctttacaactgtcagcacacctccaccccaagtgcagtgtatcacacatgaaccaggagagcctgggacacagtgaaaaggaatctgtaaatacccatgatgtcatcgcatccacacttggggaagccatgcagcttgctcacagcaggtgctgggggtgtgctgaggctcttggtcggcttggcctccctgctcacacacccaggtcactctctgggaaccagtgcggctggggtggcccctggcaggtttgcctccagagacccctcccttcaccattggatgacagatccccgaagaagccatagcctcctgggaaactccatctgacaacgtgagcaaggcttgcccccgttagtgaacatgctgtgctttctgacagctatgaggatggacttgatccaggtggctgcccttttgtagctcactttgattctaacttcagcgttgcatgatgccctatgaatggaatatacaatgtgtgtctttcacatctgtcttctttcacttagaataatatttccaatggcatctacatttttagtatgtatcattacatcaaacctttttgttgctgaataatattccattaatggatatactaaaatttatccatttatcagttaagaacgtttgggtttttttcactttttggctattgtgaataacacttctaagaacatttgtgtacaaggtttcctggggatgtatgtttccatttctcatggctacatacctaagagtgaaattggtggaccatatggaaactctgtgtttaaccatttcagaaggtgccagactgttcccagtgtacatgaaccattttatatacccactagctgtgtgagggtcccagcgtctctccatattcgagccaacatttattatcaactctctttttgataaagtcatcctagtggttctgaagttgcatctcatcgtagtttgcatttgtgtttctctgatgttgaacctctttcacgtacctattcgccacttgtatatcttctttggagcaatgtgtactcaacatttagtaatttttaactggtttgtgttttgtcattgagttataagaattctttatatattccagataaaaatgctttacaagatataatttgcagaaatattctccttctgtgggttgtcctttactttcttgatggtactctttgaagcacaaaagtttttactttggatgaagtccaatttatctattttttcttttgttacttgtggttttgatgtcatgtttaagaaaccgttaactagtcttaggtcatgaaatttattcctatgctttttccttttttaaaaaccatcttaaacattttaaattgtacaatttagtaatgttatgtatattcacatcattgtgaaatttagatctttagaaattttttatctttcacaactgaaattttgtacacattaaatactaattttccccctactcccacccccggcccttggcaaccactactttatgtttctgtgatttcgactaccttaaatacttcatatgaagggaaagtatttgtccttttgtgattggcttatttcacttagcataatgttcttgagattgatccatgttctagcatgtgacatgatttccttctttccgtaggctgcttagtcttccattgtatgtatataccatattttatcctttcatccaccaatggatatttggattgcatctcttggctactgtgaataatgctgtaatagggattgtatggaatttgtaaattgttttaggtaatatggacattttaacaatattaagtcttcaaatccacatgcatggagatgtcttttcatttatttatatactctttgatttcttgtagcattgttgttttgtaatttttagtgtccaagttgtttgcctccttggttaagtttatttctaagtattttgttctttttcatgctattataaataaaattgtgggttttttgtttttgtttgtttgtttgtttatttgtttgtttttgtagtagagacaggatttcactatgttggccaggctggtctcaaactcctggcctcaagtgatccgcctgcctcagcctcccaacatgttgggatcacaagtgtaagctgccgcacctggtctgaaattttcttcttaatttcctttccatattggtcattgctaatgtatggaactgcaatggatttttgtgtgttaattttgcattttgtaactttgcggaaatcatttattagttcttacaggtttttggtggaatttttagggttttctacatataaaaccatataatctgtaaatagaaataattttacttcttcctttccaactggaatgccttttatatatcttttccttgtctaattgctctggcccagtactacgttgaatagaagtggcaagagtgggcatccttgactttctcctgtactttgaggaatagctttgtcttccactagtaaacataatgttagttgtgggcatttcatgtaaggcctttattatgtggtagtattttccttttattcctagtttgttgagtgtttttaatcatgaaatggtgttgaattttgttgaatgctttgtctgaatcatgtggtttctgtctttcattatattaatgtggtgtatgacttgattgatttttgtatcttcactcatccttgcattccaagtataaatccaacttggtcatgatgtataatcttttttttctttgagatggagtctcactctgtcacccaggctgcagtgcagtggcgcaatctcggctcactgcaacctctgcctcccaggttcaagtgattctcctgcctcagcctcctgagtaactgggattacaggcacctgccaccaagcctggctaatttttgtatttttagtagagacggggttttaccatcttggctaggctggttttgaattcctgacctcgtggctctgacatggcaactttgctgagcagtacagggtgttcttgtccaggagtccatggaccttcaggcaatctagcaaaatttggagtctgtgatgggcttggaaatttcagtgaagatttgggagtgtcctaaccccagctatttaagagcctctgctttagatggtgtgagggacccaacaaccacattctatatagctgtcctgggcatgcttggtcttcccagcaatgaattttctgtggtgtggtctcagagctcacttcactccaccctgagactcttgtacagtgaagtgcaaggatgtggccaggccaattgtcagcagtcagctcctggcctgcctaactcaatatagagcatgcgtccactgtgtgctactctgctgcccagagtcatcaggctcatgagccagatacaaatgctgagtctggggcctgcgtgcccgagaggccctttcctgtcagttggcccagggagcatcacacagggcactcttctcctcagtctctctcgcatctctctggcagacaggtggtcatgatcgtcagtgctgtggggccctattattccagagcaaatgctggagccagacttaccctgtggaaatgcacgaggacgtgggctgtggtgatgggcaccctcagtcaggcaccagctgtcccgcgttcctggcttccacctctggggcagctccccgacattctctgaagtctgtccacttcgttttctgttacatttgcccttgtcagggggagcagtgggctttggcctgtttacctaagccctcatgtgtgtgctgcagcctggcttgggacacatttggtctccatgtgaagaccgagattgcaactttctgtgcttggagcccaaaaggacaggtggggcctgagggagggatgcccccatcccaggacaaggaacttcccccaggagagctgctcatggccccctgtaactcccaactcccatggaggggctgacaggggctccctgcaagctgaggctctgagcacagggacacctggggccccacataccagccccatgagaaatagggccaaagagcctcattccccctgtgagtggctggtcacccacacttcagggcctcatcctgcgctgatctgcacctgacatgctgagtcttccttgggcttcatcccctggagtcgtcccctattcctggctcccatgctggtggccctgccttctcccccaggcacccaaggactctccaggccatacctcagtgacagcagctttgccatcccactggcctcaaccccagaaaaacttcaagagagcaaggcccaggattttaaaagggctaagactaatgttacagaaaatggactgtgagataaggaattttcacaagtattctccaatttatgcagagaatgaaacagaaattgtggaattcaaagttgcaaaaaacaacactaagaaatagtggtttaagcggatgatgctttcatggattcagggaaatgactgctatccacagagtgtgcagaggaagtgcctggtcctggtgggtagcatggctgtggctcatccaagagaatgagacagggctgggcaagccttatatgtggaattcaccagagtgaagcttggccagtgatgcaagggaaggaccacgatgctgaaggtgttgactaccaatttttgccaccatcaaccctgattcaaagcatttgctgaagaaccagagcagactgacagtgagattttgggcccctgggccagtcatccctacaaaatgaaatatttctctaagaacaggacaatgagtcaccattttcccaaaccacagaccatatcttaatagaacaactttttaaaaagtttttattttattttaaagttccaggatacatgtgcagaatgtacagtttcattacataggtatacatgggccatggtggtttgttgcacctatcaacccatcttctaggttttaagccctgcctgcattaggtatttgtcctaatgctctccctccccttgaccctgaccccctgacccccaacaggccccggtgtgtgatgttcccctccctgtgtctatgtcttctcattgaatagaacaacttttaaaaatgtgcagctggagcagccttgaagggaattggtaagcagtgagtggagagtgatgtgtttcagggaggatttggactgtctggcttgcaggtgaccctcttgtcccacagaggcagtctgccagtaactcatcaggaagcccaggtagtcttcctcaggcacttccatcattcctgggatggcagagatgaaaagggactggaagagatgggggcagagaacagccctcactgacagcacagagcctcacctctccacacagtctctgtctcctctcctcctctgcccacacagtgactcccagccgctaagattcctgctttcagcaatgcccgatagcacaccaaatatctgaggagttctcaaacaccaactcttcactgcccattagcacaatgaagaaactgaggaaaatgtatatgtccctgaatgttgctaatggtcttagggcaaactgctacttattctgcattatgtatttcttagttaattggggttaggatgtcatttttaatgaaatgatgttaatagtgtttgtaaaatgaacgatgtgcaaccccatgaaaaactctgtgctttttgaaggagtaaaggaagcaaggaggtgtgataaaaattttgattgttgaagtggcatgggggcaggttgaacttgtccaagactgcttccctgcaggccagcctccttaaatgcttcatgaatgctctccatcgctgggcataaggtcatcaaggctgagttctagtagaagagacattctagaggtctagaatgtcttatacaaacacacttagagacacctgttctagtagtccaccattgcctccactccttaggtcttgaagcaaaatcatattcattcattctacaagtatctactcaagatgtgatatttgtcaggtgagtgatgagcacaatggttgataggcagagacaaacaataataaaaaaatgagtaataaagggtaatgaaggctgggcgtggtggctcatgcttgtaatcccggcactttgggaggcggaggcaggtggatcacctgaggtcaggagttcgggaccagtctggccaacatggtgaaaccctgtctttactaaacatacaaaaattagccgggtgtggtggcctctgctgaactctcttttgtgttttaatgtaaggttaaggagctcctgggcctttggggattctcagccaaaccaggtcccatcatcatggctttctcccgtctctgcacgggcggacagataatctgctgctgcacacaggacacacagagctcacccctgctcactcaggctcacctcctaggatgcctcctaggcaggcagaagttgaggctggctcgccacactcacattctgggaccagggacctgcacctgcccttgctacactcaactgtctctcgggctgtcaccactgccctcagaagagctcacactgctggggagcccaactgtttctcaggctcttgccaagaggtggcaagagagtttcccctacttacctgcccactgggaacaaaactttatttactttttattgaggtaaaacagatttaacagaaactaccattttcatcatttttgagtacagggtttattggcgttaagtttattcacattgttttctcaccatcaccgtcaattcatctcaagaactttctcatcatcccagtatcagactctgaacccattaaacacacagctcactgctcccctttttccaagtcccttaatttgaagtgcaatgaggagactatttttgaaattagaatgttcactttttgttgactttctccatgaaaaccttcccttgatttagtcagaagtccccacaccctggtttctgggacagattcctcccaggcctcaggagactgtgccccatctgctgatgatgccataatgggaccccaacaggaaaaccaggatatctaatgtgcaagggcggggttttcaggggagaggaggggggttcccgagaattctggtagcatgtctggaactagagccttgcgtgggaagtgcggcatttttctatcagtgaagcactgatagaaaaaatggggagacaccttctgagggggcatcacaggcaggggagaggagaggcagacaagcactggctgcacttatactcaggccactgagcagcggaaacagtccagagtgtgtggtgccactttcccattgggatgttgtgccttttcttaccaatttttgagaacttttggaatattatggataatattaaggataataatccctttcccagttccgggctgctccctgtggccagagaaggcagccttgaaggtgttgggtaaagaccacctgcccagctctccaggcttgctaatgcgggggaaggagatgcagcccaaggatcctgaagctcttgcatcaagtagctatactccacccagagctgccggccacaggtccagtgaaagaaaactgtcaggaccaccactgctgctgccaccaacccctccccggcaatagaggtggaatagagatgacctgcccccacctgctaagcttccctgcctatctcctgagggattcctgggcaacgtggataagaaggacaccagtagaacatcagaatccaggagactaaaacagctgcttgggaagataaagaagacatggcagggcaggcatggtggctcacacccgtaatccgagcactttgggaagctgaggcgggcagatcacgaggtcgagagatcgagaccatcctggccaacacggtgaaaccccgtctttactgaaaatacaaaaattagccgggcatggtggctcgtgcctgtagtcccagctactcaagaggctgaggcaggacaatggcttgaactcgggaggtggaggttgcagtgagtggagattgcaccactgcactccagcctggcgacagaacgagattccgcctcaaaaaagaagacatggcaaactgcagtgccacccagcctgcccctgctgtctccacacctgctgagactccctgcccgggccacctacacttcacagatcccagctcctcctcctacctctgacttggcccacatggctgctgggcccctcaccctgcctgtccctccaccttcgcccacaccaagaattgagtaaaaattgatatccataattcctaactctccccggggtcttcctgctgaacttgcccccattttgggggttccacctaatgagaaaggaggctgccctcattcagctgcagcttcagcacctctgacctctcagccctgccccatacctcctagccccgcatctttctccttccagcttcccttcagaagggagcctcctacacccatatgtgttttcctctcctcctctttcctccccaactcctcttccagcaccttccaccgggatccctgctatcactcatcagcagatgaattccacagcagccatttccaccatcacagcaagggcatctgcccacctgaccttgcagcctccttgagccctcagctctttgctatggacatgacttccactactaacgctgtggttttcaaatcttcaccaagctccagagtgagcaccctcttaatttcccaaattcagtgcacaatagaggcaccctggaaagacatcggcttacgtctgcctggctacattcatattctccaggcccacccctcagcccacacttggggccccctgatgggcagcaatgaaaagcctctgtccccagtgcccctgtttttccaagccttcccatcagggctcctccaggcaactccagtttatggagcagcgtctctgcaacatcctcctccagaacagattgtgcgatggggaatggcaccacaactgctgcaactgaacacaattagggtccccattcagaaagagcgcccaaggcccacctggtacacacaggtggtatgatgaggaacaaataagaagcaagtctccctccacatatggtccccatgaatggacattgctcctggaggaaggggctcagtccattgaagttaaatttaagctgctctctccttataaaagccagaggccccaaacctcaaagtgtgtgtgtgtgtgtgtgtgtgtgcgcgtgtgtgtgttggaggaggatgtggggctgatgagcccaatcagaaccacagtgtatttgaggcactcccctgtggacagaagaagaagccagcatgtgtcatcatcatctgtgccctccccggcttgactgttcatctggctgaccaaagcccccagccaggtctctattctttgaactggcaggatgcccgctgctatttccaggtgcccctcttccccttgcctgtttactttgatgggctcttctctgtcctgattgtaaattaaaaccttattcttgttgctctgcctctgttcatgtgtctatatattttataatatatatcttacatattttaatttttaattaaatattatatatattaattatatgtaaccttaaaactagatataaagaatgtaggcatgtagataccttgcaaccataaaacctaaagaaacttgcagatcaacaaatgcagagacctcataaaattcaaatgacaatattaatataatggaacaaaggcagaacagtcactcccctccgctgtgaggaagtggcgccccctgtccacatgcagactctcctgagacccgcctgttggcggtgtgctttgcagtaattggctgcttccaccacttgtccctatgtaagttacacagaggcttcctttgcacatcctgtaatgaagccttttggccttcacttggtgagaacacaatatttcatattaactccctgtgcattcttttttttctttaatatttctctataacaaagaaaatgtcatgccctggcaccaaagaaatgttaaatagataaaaatatggaagctctctgttaagtcgatcatccaaatgaaccaaaatatgttgatcttgatcggtcactccacatctccagcaatatgaccctgtaggcacctgatctcctccattaacattttatttacaaaatcagacttcaggccaaagctggctatggtttgctgacccctgttctagtagaagagacattcaacaactaattacacaaataacaaccactaagtgctatcaagtaaaagtacccaatgcttaaaaccctctaagagtagagattgaacctatgcaggtagatcagattgccctgagggagtgggtcttagattaaacgtagttaattagtcaggtgagggcaagactactccagatggaggaaaccacctggggaaagggttggggcagaagacagcctggcaaacccagtttgaaagaggcttatggagcgggagcaggaagagtgagggccagcgcctgtgagctcaggctgaaaacagcagggaggccagcccctgtgaggtcctgtgggtcttgtgagggaattaggtctctatttaaatacagagactgcagcacaagacaagatggagttggaagcctcctctgttcacctccagacccaccttctgtatcctctttgtgttcattttggttctaggcttgcccagtgtctttacaagttttcctccatgcaattccaaaatcttccaacaaaacaaaaaggaaaggaaattttgtctgcacctaggctatcctatagtggaggacctagaggactggagagagctgtgttcctgcttctcctttcctctctgatgcccccttatatggagtcttagcaaagctttctctgtcctcgatgtcaaaggagccttcagaatatcacctgggctcctcctcctgtgttaccatgccttctgggtctcgccctgcccgcctccgcactctgtcctcactgcctcacttccacgctccccttggggacacttgcacagcttgctgccccgtgaatgctccatgtccccttttcagttccacgttgttcctctgctggaagagcatgtgcctcgcccggcccctttgtctggacaccttcttttctttaagaatccacccaggaatggctcctgatgcttccaggtctgcaggaagccatccccggccccttcctcatccagcctgagcgctgtgctcccctgcagtgtccacacagttcccggtatgaaagactgacatcccaaactactgttcacgtcagcctcctgcaccgcaccctgagcttgtgagctctatgacagcaaagggcttatgtgaagggcgtttggcactttccacgtgaagtttaacccatttaccttgttaattcccatttgttcccacctcttaggtacccgcatatttctatccttcagatttcctagcactgggccttatagcagcatttcttaaaatggggtccccagtccaacagcatcagcatcacatgggaatttgctggaaatgcaacttctggagtcctccttggacccctgggatctaaaactctggggttaggtgcagcgatctgtgctttcataacccctccagctgacactgaggccggctaacgtttgagaaccacggcctcccaggaagtcactgctcatgaaattgttgattccctgaggacagtaactggttattttcaatctgaaaaagaaaaagagtaactggaggaaatgacaaagaaaatttttactttagaaaaagaattttccaacttgatatttcaaatacgtgacttccaaagaaggcctagctttgtacatttaaaaacaaggttgattctgcctggctcagtctaccccacgtgtggttttgctgaagggcaggtgtttggaagagataaccttaccaggtgccctccactgctcagattctctgcttctaggatattctatgtagcataaaataaatataagctagagaggagggcatgcttgctaggggagtaaaaagatggtttctgttttgcaggatgaaagtattcatggatggatggtggtgttggttgcataaaaatgtgaatgtatttaatgccaccaatctgtgcagttcaagatagttaaaatgatcaattttatgttatttatgttttaccacattttgaaaataaaaataaaaagataaagctggcacctaaaaatgtccaggtaacaataaatctggcagagtgaagtacaggactacccattgtatttagagcagcccagcaaagcagaggcccctagagaaatgggggataagaaaagtgaaagattgttatttccaaaataaccacctacaaagtacaaagtggtcttcctaatgggaagaagtgattgttccttggctcattttcttttttttcctttttttttttttttttttttttttttttttttagttttcagggtttttgttcagtttgaattcatatgtgggaggatgtcatagtgtttgcaggcctttggattcttgagaacttaatcaggccaagctgttcatgaggagtggggtgctcaaattcattcttccaacaaggggctgttgggtaccactatggtgccagccctgtgctggccacaggtatgaaatgcccagtgagggccacatcctggctcacctaccaggccacgggctgagccccacagttgcctgagaaatttgctttcaggggtaatttgtagagattgtagctgagctttgggtgacaacctgaggtgcggtcagactttatcatcacaaccaaaagtcacatgctgatgagaggctccaaacaacacctggagcccatgacccagcaacttccagatgttgagttgggacagggaacaggcttgtctgctccaaatgaatgccctgaccagaaagagtaaaccagggaggcactcttgaaagagcgtgttaaggagcagtgagcccccttccacctccaccaggaaacgtccccaggacagacagctgccgacctctttctggaagcgctgggcctcagaagattgctggttcctgcctacttgctcccaaggcatattcttgatcagaaaggagggaagaagtgcgtaggcatggggaggaggggcagggaagaagtcacaggaatgcccacagcagaggtctgtggagatgctgggctatccctggtggcaacactcttggggctggcgctgggtgaggatggcctccaaagcaccctatgctgtgactccagcccccgggatcctcctcagggtacagagaaggagctcaggtgagctctgggtggatgataccgtctttttccattgaaatcacagaattttacagctaaagagaacttccagatgatttcagtcaaccacactcttttgggggctggaagcagagatgaaaagatttagacaaaattacacagttcaatgattaacaattcagactaagtgtcaggccatctgaccacaactgaggccccccgatactactctactaagtgtattatactgtggtgtgtatgtaggtgtgtgtgcacatgtgtgtgaatgtgtgtcaggactacatgtatatacatgcgtattgtgtgagtatgtgtgtatttgggcatctgtacataagtgtatgtgtataggtgtgttgtgtgcatacatgctcatatgtgtaatgagttagtgtgcatgtacttatgtgtgtattgagcatgtgtgtaattctatgtgtttgtgggtgcacatatatgtgtatttgtgtgtgcttagtgagcgcttcgctggccataatggcttgtttttctggccaaaagacgtgattctccctgattcagccgtgagtgtgcatttcccagggtcagggtgactaaccaggacatccggagaactttcttcttctctgccccacccatcctgcctactccattctcgggtgtcagaggctgaggctctggccccagtgtgagccccacaggaggtcttcagagccctcaggttgcctcacagccagcctccatgagcatctttctgttttccaagagggtgagccagggctgctcctgtcaatgacaagatgctgggacctggattcacgtgcaaggagaaaccaggcactgggggctgagcgtccagctgctgctgggctgggagtcagcaacctctgtgcttccagggctcaccctccctggccatgggcagtgccccttggctttgcggcaatttgaggcaatgaaagtttttatttcctctggctgtattttctagacatattttaacgtagctataatcttacaaaatgttgaattttttgtcctgcttttaaaaagattttaattaggttagattataaccaaggcaggtggatcacctgaggttgggagttcaagaccagcctgaccaacatggagaaaccccatctctactaaaaatacaaaattagctgggtatggtggcacatgcctgtaatcccagttactcgggaggctgaggcaggagaatcgtttgaacccggaaggcagaggttgcaatgagctgagatcgtgccattgcacaccagcctgggcaacaagagccaaacctcatctcaaaaaaagtaaataaataaataaataaaaatgactaataaatacttactgaaagtataagtataaaaaactttaattatgttaattatgagattttaaaactgtattactggagaaaagagaccaaatctcctcataatactttttttgtttatttaataataaagatgaacataaacacctgtgcaattcagtgtttaaagtttgccaaggtatatgtatatatttttcccaacgttgatgctgtgagaagcccaagccatggagaggccccaggcaggtgctctggtcaacagcccaagctaaatgcccagccaacaccagcatctgcaaccagccctgtgagtgagggtttgcagatgtctagtctcgtcaagccctgcagatgtctagtcccatcaagccctacagatgtctccagcacagatagagcctacagatgtctccccgtgaaaccacacagccaagtccaggcggaaaatgtgaaagatgtttctaccaagccactgagtttctgggtggtttgttttacagtaatagaggagaaccagaacggtctgttcctgcactctccagtggtcccctatgttcaaacactccgcttagcaagcttcatcacccaacacctggacctaatcactctgcagggtctctcactgcagtcatttctcagggttactgacatgctagtctctgctaagatgctcacctcttcaccttcccttagtgactggctgctctggttgatattgtctttcccttcctcccagaaaccctccctcattacctccctttccctaacagttgcagctccttgaggtcagggcctgtctcttccaccatggtgataacctgcatatgttggctgctgcataaattctaactgtatcaaatctaggacccaacctgcacagttaagggatttaccttgggaatcttcccaatcttcttgctaacatgggctacttttattataaaatttcacagttgccatttttgtcattttatgtcaaaaagatggttttagcaacaactagggaagggcacgtaagagtccagcatggcacatgatccagttcagatgaacttaaatggagcctgctggaggctttgtgggatgagaccccattgtcctcctagttttcttcctgaaagattatggagtctattcactaaacacttctaactatcttttatttttttttcagtgggaacatgagacttttgaaaaaacacaggtgatgaaactatgtgctcttttagccaatacaatgtgggaagtttttctgttggttaaaataattcaggtgcttacaggtagcttggtgtgaatgtggccacagactctcagtttgggtcctcttgtctgtcttccaccttccaaggccagcacaccattcctgaagcccagcctcacaccctggagtttatccctcatcctttgaggacccaaagacaaacagccttgccaacgcactagtgccttctctcacctcaactgtaaagtggccatggggtcttcaccagcagctggggaagatgctccagaaactggccctgatagctttgccctgtaacttgactgggttgcaaacattgtgggtgagataaacatgatctctaaggctctttttcagtattgaaattacatgtatgtctgatcactttaaagaaaaatgtgaattttttctttattaaaacaattttcctttgtccttatagatcgtttgtcatattttgcttcaatcaagagttgtgtcagacacaaccactgggcagctgacatgagatctgcacatttgttactagaagagccagaaggccacccactgttcctcctagtgaaccactggtagagcaggtatggcttagagcccagtttcatgcttgactactgatatggtttggctgtgttccacccaaatctcatcttgaattttaactcccacaattcccacatgttgtgggaggaacctgatgggaggtaattgaatcatgggggcaggtctttcccatgctgttctcataatagtgaataagtctcacgagagctgatggttttataaggggaaacccctttcgcttgactctcattgtcttctcttttctgctgccatgtgagacatgcctttcaccttctgtcatgattgtgaggcctccccaaccacgtggaactgtgagtccattaaatctctttcttttataaattgcccagtcttgggtatgtctttatcagcagcgtgaaaacagactaatacaactacacaaaaaagtcagtgcttcaaaacagaaagaagccccaccagtacatttgaaattacagtttatttaaacaggtaaaattgtatatatccttttaaaatgaaaatacaaagtaagtgaatcaataatacaaacatgtttatagcagtaattaaaatacaggtaacatttaccagtgtgaaaatatcagaattccactcacacttggatcttcaatgattgaagtgtgcattcaacacagcaggtgctggtagattgaagataaattcctcctttggatgtgccatcctcagtcaagttcttcctcatcaccatccatcagctcacacagtggggtagctggctgctgtggcaattccacagttgttcctccggtctttggccatctttatgtagccatccatgccccagtttttaccccagctgaaaggagagcaggttttccatttcagaggaaggataaagcacactgggttattaatttgaacagtgagccagaagccacagtgtgccagaagccacagccttaacataaagaatcaggagatgctgatgttcctgttcatcccttgtaaattcttgagtcaaaacctgcatatcgcttcaatcccagacccaaaactgtgacctttcacagaactgcaaaatcagaaacagaaaaaggataggatgtctttccagccgatctacttcagaattaagaaaatgttcagaatttagacatgcaatgggacaaataccatattaatatccccagcatgcttgtgacagtatcttgatgttacaatcaatcattaatattctgtgttctgcctaagggggaaaaagacttctgggatttcagaaatgtgattaagggcttgtggtatgtaaatactgattgcaaaaaaggattcccttttgaatttcaactataagtctttctggcaatttatacctgttcttcaccagccaatatttattgttatctgagtctgctccttcatagctgtagccaaccaccagcatagcatgatccaggccttcagggtcacagcgtggctcaaaataaattcctgagagaataaaatgaaggctgggtgagaagttcccaaggacacctgacagtaacccaccctgtcacccacagggagggaggcatctctaaaatcagtgaaatgacacacagtccagatcgggcttaacaagatctattgttatcaaggctagggaattaggctctcatccacaactagcagaaatagaaattagcataagtccctcataaaaaaactttcctacaggcataaaagaccactcattttaagcttgtaattctactctagaatatcaatcttaaaaatagcacagaacaccaaaatccttgactcaaaaggctcttttcagatttaatcacagaagtaaaaatctttggaaaaattataagaatacaacaattagacaatatttaagtaaattaaactatactataaataacatagctatttataaaaagttatgaagtacaggtattcatggagatacgctcaatgtaatatcaaatagaagcattgggtatgattattgcgtgtatagagtccatcatgctggtgtgtcatggtggtttactttttttctgcaataatttctatgaagaaagatgcttaccttttttatagaactggaagaagacatggcttgcaccaacagcaacagagatgggccccacagttgccactgccttcgccaggtccttctcccgtgaagggatgtccacaaaaccagtgtcattagcagcagaatacttgggattgtacctacaggttttaaccttttaaaggtgaagagggaggtgacttgattactaccatccttctcctggggaatgtgagtcagaaccacaacactcagcagtttgcagcatagaatttccaagtcaacactgttacaaatcatccaaggaagtgaaatgttattattaatagttaatttgaaactgaaaattagctcagttctcttcagtgagacccccaggtttactttccgtaagacatttttcacaatggagacatctgtattatatgtagaatggtttgtatattctccatgtcacatagaagcaagaacagctgcatgttaaccatgtaatcacagaactgtgcaaaggctataatttataatgacaacactgtcactttgcagatagagattccaccatctaaaacgtgaattctgaaaagtgtctgttatctctgaaagtgtcccagtaaaaccaagcaggaatggcagcaagaaaaggagctccatttacctttccttcatatggataggatgcctcagagtccaggcctccgttctcctgaacataccggaagggattatccatgaagtcaccattgcagccctcattgccttgaggcccagagcagtctaccagattctgctcattcagtgagataagtttgcctgttttccagaacatctgcccttccagagcaccagttgcactaaaagcccaacaagagccacactgaccctgaaaagagaataaaaaagctgatacacacacacacacacacacacacacacacagcaagacttttaacaacatgagtatttagctcatgtagctaaatactcctttaaaaagtgaactgcatgttgctgcacagtctaccatagcacaaatgtcaattgcttcttggctttcctggggtgatgggaggtctgaacctaacacagtctcacctgatccttcacaggagtcatgtagcctttctctctccagtccacagatgtggggatctcaagaagcaggcgttcctggaactgtttccccttcctgtgcttctggtattgaaaaccattcatcacctgcctgaattcttcattggtcttcaaagaaaagtaaataaaatgttaagaagcaagagattaatttggtaaagaactgaggaggggaagcacagagctgggcagcccacagcatacttaccatgtctccaaaggcgttcatggccattgtgaagctgtgtttcccttggctgtattcctgattgtgctgctcaatcatcttcacgtccttctctcacactgctctcctccatccttctccattctaaaggcaaacatgtaactgaggctcttcatttcttttttttttttgagacggagtctcgctctgtcgcccaggctggagtgcagtggcacgatctcagctcactgcaagctctgcctcccgggttcatgccattctcctgcctcagtctcccgagtagctggaactacaggcgcctgccaccatgctaactttttgtattttttttttagtagagacagggtttcaccgtgttagccaggatggtctcaatctcctgactttgtgatctgcctgcctcggcctcccaaagtgctggtattacaggcgtgagccaccgtgccccgccgatgctatttatttctaattaaaacccaacatatgctaaccaagtgaatcttcagacagagatgtaagagtaaccatggccagggaaggcttgacacttctaggagatgttctccaagctaagacacaacaagggtgtatgcccatatcgtgctcataatcagtgctattaagttattgcattaggttattggtaggagccagcctctagaagccactctctggccatatgatcccaatagcaatgcccatctctctggggttcccctggacagtttcagatgccaccaaccatgccatataatctcttgtgctttgccttccacttggtccattgtgcgtctaaactgtggtcacgtgttagagcagctgaggcaattcccaggcaaaaggcagccaggaggagtgaaggattcatgtttcaaaaatctaggaagggaaaagaaatgaggatctgattagaccgatcctaaaaagccattttactacgccctgagaaactagaggcaccatggtagaaaaaaaatatttaaattattcttccaagcatttacctaaggactgtggaagaggccaaggatgtggctggagaaaaacagggcaagtggaggtattggatggacccaccaaaatgaaaagcagcctgtccagagctgtaggagttgaaacagttttatggggtgatgatgacaggctatgaaaaggacaggaaggtacctgatgggcgagaagcttaaggcaacaaccaggaaactaggaaaccgtcggcccaggttttgtcccaattgtgctgaggtcatccaggcaaaacctcaagaatgaagacatctaatttcaagaagggacaaagggatccccaataattgggaagtcacgtcacaccttgttcttggctaatacacagcagaaggtgaagtatgttttccaaatgccccttgtaatgaaacagttcttgaatgtcttcccaggacaaactgggaaggggagcacctatctaccgccgttcccgcggtcctgcagtcctgcaggtgggccagtcctgccaactctccaactcccctcgcagagcataaactgaatcaggtggccgaaccaccggacgccagagtccccagtgtccgcgcccacacaggcgtaggcagcttcccaggctttgggctggggacccaggccaggtcccctggctcttgctcccgccctccgctcatgctcactgtggccccaggacgtgggcgatgttgcagggagcaaggggcgcctctgcctgacttgccggggtcgagcctccctgtcccaccccaccagccctgggaatactgcggcctggcactcccgaaaatccctcactcacagagctgaaggacttgctgggtccctggtggcccctgtccaatcttagcccactggggtctcagctgctgtagccacaggtggacaggcacagtgggcaggtgctgggtccaggagtctcctgtcgcctaaggccgcccgaaagcagctaactgacctctaaagcccctagacccccctgcccccttgccgcccaggcaggcccgcccccaccgcttgcccgctctgcgattggctgcgccagccgctgggcggggccttccggcgtgctgactcctggcatgtggagcagctcagtccccttgcctcagtggaaccgggggaggggagctgggggctacgaagagaagggtcggaggcctccctggagggttcggatcaactaagtaccctatttaatgccctgggcaggtggtttatgaaaagaaatttacgggagccctgtgtgcattttcagcctaaccctgcttttcccttaggcctagaatgtttgattaaaatctcctgcagggcagagagccagaggactctaatccagtggttcctgtttagtccacagcaaaggtgcggccggttggaagaacgcacagcctgcaagcagaagccttatctcccaattaagggtgtagaagaatctgggcgtgttgctggtggctcatgcctgtaatcccagcactttgggaggctgaggcaggcagatcacttgagcccagtaattcgagaacagcgtgggcaccctggcgaaaccccttctctactgaaaatacaaaaattagccgcgtgtggtggcccgcgcctggggtcccagctagtcgggaggctgaggcaccagcatcgcccagcccggaaggttgaggctatagtgagccgagatcgcaccactgcactccagcctgggcgagaggagaccctgtctcaaaaacaaaaaaacagcagacaaaaaaacaactggtaggaaaacgcaccctcaaaacacatgatgagatggtcgagactagaccctaggagggtggggactggctgggtgggtatccagagaccatgggcgtttcataatgcattgtttccagtctcctccactcagcgactcttcttcccctgaagtcttgcattaagtaagtgaatgaatcaatcatcaagttaatgaagctctgactttgtacttgtcctttgcttggtacagttgggcactgccttagaaacaatctccaggtaattttcccaactgcttttgtgaggcccagttttccattttaaaatctaagattacctcagtaatcttgcttttacagcaaatgggcatggagcctgacagatatatttaaactaagttatggacaagctgcccggtgcattaggtagcataggagctaaccttgtgggacatctccccatattcgtaatattcacccctacatctataatcaataaatgcttgtttggaggccatagaaactcttactgagatctgacctgtgtcttctgctatctgcctgatttctccccatagaacaggaaaacaccgtgtaggagatattgtgaatagaaatatgaatataggccgggcgtggtggctcacaccagtaatcccagcactttgggaggccaaggcgggtggatcacctgaggtcaggagtttgagaccagcttggccaacatggcaaaaccccgtctctactaaaaatacaaaaattagccacgcgtggtggctggcgcctgtaatcctagctactcaggaggctgaggtaggagaattgcttgaacccagggaggcagaagttgcagtgagtgagttggcaccattgcactccagcctgggcaacagagtgagactctgtctcaaaaaaaaaaaaaaattacaaaaattagccaggcatggtggtggatgcctgtaatcccagctactcaggagcctgaggcagggacaacggctcaaacctgggaggcagaggttgcagtgaaccgagatcgcaccactgcgctccagcctgagagacatagcgagactccatctcaaaaaaaaaaaaaaaaaaaaaaagaatataaatagaaaatacagtgattcaaataagcaattgttagttcctcagatcagaactgtgagttctatactagactcttacatgttatttcttctggtgtcttagcaatgattctgaataaagatcagactccttagtcagcaggtgggacagttctcaataacagaagctgggttctcaggggatcccgtggatatgaggatgaaggttagaagcacttgggaccatacctgcaggtctgatttgaggacaatgagaccaagacaggaaggcagcacctgctgaggggctgggggtgggagaagggaggaaacaggacacaagaaaataagtataaaccaccagactgcagtcagtgatcaacaaaattcccaagtttatattgagaagatttccctggtttggggttttgaagagattatataagggactcgggttgcttgatttttctcattctttttcttttaacttggtctcaatttttttgtaaaaaaaaaaaaaaaagaatgtcttatgtgcgcctttagaactggtgaatgaatgaacctccctttttaaataactgagattgtcactgaagcactgtcatccgatttaggcttaaaaatctgacactgaatttatcctaggtgataaagtgcaagtctcttgtctcctagaaatgatcaggcaaggaaacacccaggaggcccagggcaaaatgccctcctggaagctggtggggtaggaagatgctgaggcccagtatggtccctggagcatgcattctgtgtggtgacagaaattgtttgcttgaccatacattagtcaggcttctgaaccttctgataaacgcatctgtgcactttttgtaaaattcagttttagcaaattaccctgctaagtcagtttagctggcaggaatccccgtccaccatatactgatcagggtcctcatcccccaccatcccgcagctgatgtcagataaccttggcctgtgctcagcgagaatctcgttaggtcagtttagccagaatcctcccttacccttgatgttccctcgtagtcatttcctatctgctaacccccatcctcctccttgactataattcccacttccttgtgctggattcagagttgagcacaattgctctctcccactgtaagaactacttgcagtgctcctagacctacatatgtgaacctgtttctttaacagtgactcacctgtctttttctcctttcaacttgatactagctgaggcttatccgcatcaaagtggagggactggccccgggggatcctcagggcttcaccttgatggcctgcaggctcacattccactttttctggtgccttctggctcccagagtccagtttgccaaacaagtgatggaggttggaaggagggatgaggtgacagaggtgaaggagggtaaattcttttctaagccctacttgcctgacatgcatttaggtttttagaaaggaacgtgaccccaccctttattttgtatctcccacttccatgaccagccttacctgtaaaaatggggcatagaagagcccccatctcctagggcagtggttttgagcagggggtcactgaccagtagcaccttcatctcttgggaacttgttaggaaattctggacttggggtggtagatcatgcctgtaattccagcactttgggaggccgaggctggcagaacacgaggtcaagagatcaagaccatcctggtcaacatggtgaaaccccgtctctactaaaaatacaaaaattagctgggcatggtggtgtgcgcctgtagtcccagctaatggggggccgaggcaggggaatcacttgaacctgggaggcggaggttgcagtgaaccaagatcataccattgcactccaacctgggtgacagagcaagactgtctcaaaaaaaaaaaaataataattcctggaaatggattagcttgctgacaagagttattccattgtgtgtttctacctgcaatacctgaggatgcccattttctcacgatttataaactaactcattttatagacgtaattttcatacatttgggggtatcattctaacttcattattattacttcaaggtgttattatctccccgtcatcatcatggtcattatcataactagttggtgctgacagtagtcaccctgcattgagaactcatgctccaggccctttccacatagacttgatttaattccattcactcctcacaacaatcgtctgaaagaaagactcactaagccattgtataattgaaacacaagaggtgagtgacttgtgtgcccttgggcaggtaatttaaacactctgtgcccccaagttccaatagataaatgtaaataataatatctttcttacctaatacatggggtcaacagttaaagtactgtacatttgtgaggtatttcatggcacctgtgaattgctcatgtgatgacatagtgtgcttccagtgtcagtgtgctgggaaggagacagaataggaagaagactgaaaagatgccgagtctagtgcagggtatcctggggaaaacacctcctgtttgtccaagagcgattggccacacattgaagacacactacctgcctgtgaactggggtggccctgttgaaatcttgtggaaagcttgagatgctccttagagggtgtttatccctcgagctggcacaaatgcagtttgttgttcagtttttccttctactctgcctctatctggtacaaaatggaattgaagagtatataaaccagcaaggaacaatctgaaatcagaatggtgacaatggaagaaagtaatcttggttcaacccaatgttcacctgaagtctctttattaaagactactaacaggaacaaaattgcataataatcttcctatgataatttcaagttccagaatttctctacggaactttcaaatttcacctctgttaactcatggaattttccctagaatctgcaaattaccgaagtctttggaggtttgatgatcactcactggtcagcggtactataaaaggattctggggagtttgactcagtggtcagcaaaggctcttccgaatcttcagtctgattctgagattccccggggagaactggaggctttcttaacagctcttgattggaaagaccacctgcttcatcctctattgcaacagaaatagccattgtgaagctccatggggaggcacaatgagtttttcctagcatgtgtgactcaggtcattttgttctgtggtttccagttgtggggacttggcaaggtcacaccctcccctgagcctcagtttcatcactcagaaaatgaggataacaattctacttgcctcataggattgttgtgaagattaaatgagacatgtaaacatttgcttatagtaatttcacaccactttattgtggaatcaaagacagaattcttacagaggtcttggttagttaagaaaacatccattcaaagatttgattcacaggacaccctcactgtctttctctttttttttttttttttttttttgagacagggtctcacttcgttgcccaggctggaatgcagtggtgtgatctcagctcactgcaacctctgcctcccaggctcaagagattctcccacctcagcctccaagtagctgggattacagccatgcactgccacccctggttaatttttgtatattttttagagacggggttttgtcatggtgcccaggttggtcttgaactcctgggctcaagcaatccacctgcctcagccacccaaagtactgggattacaggcgtgagtcaccacacctggcccttgcttactttcgtacttcccatgaggcaggttaccaaattggtgaaattaaccataacgtcattgtggtgggcaagcagatatattaaaagcaaagatacagcaggttaacattaaattttgctcatcccaggacaaacctggccacaggaggcctttgccagtattctgaaaagtgttgtgaccatctcctttaaagctcagttaaaggtttctggctggactccaggctgcttcaagctctttgcttgtctttatcattctttaaggagggacccagacacagtgtgcagaggcctgaatcctccagaccattctctctccaccatgagtcctgccgtggggacctttccggctccctttggccttatgagccagaaaatcaggctagagcctaaagagaacagaaatttcataatcaggcctgttctgtgactgtatgggggagctgaaggacacaatgggctttctatattggagactacccatcatactctctctgaccagggagaaaggacagatgctgtgtgattttgcagtctgtgatttggcttcttattctcgctgctctctacacctcattatttacttcactcccctgaaaaaaatgctccctaacaggctcagtacccaacttctgggtattgctgcccacatttgccttggttctaccttttcagattgcaggatcctgaggttttgcttggagcaactcagattctccactagatctaagatctcacctagtcctgaggatttccttaaagggaaggggaaattagatagatagatagatagatagatagatagatagatagatagacagacagatagttgctgcctttgctctacagcatctgcttggtgaagaggctcaggatctggatcctggcctctcagctctcaggaaccccattcccccctgacaggggtggcaagttcatcctattattcattaagaaatttgaaaacaatcattcaggaattttaggtcaagagctggaaaaccccaagcctccgtcacctgagcaaagggagatactgtgagaacctgcaggatacacccatgttccaccacctgcccgaagaagcctgtggttcttgtcagcttctcaagggtgaagcgcagatcattttctgcttgagcagaagagcagaccaaagagctcattgactcaaggagcatcacggcaactgagctgcacctggaagagaagaatccagggtgtgatccatagccaaggcctgaagcaatggggcccatacttggcctctccagggtgagttgtgacccaagtgctgggctttagcccatgagtggtccctcttgccattttgtttcctcccaaagagaagccagtgttggtgatttcatttctcataatctccttaggagcacaggttttggtttgtgccttttttggatcaggttccctgcattgcagctgctataattaaaactattaacaacaacacagcaccacagaagcaagttagttgctaatggaatttgctgataatgctatcttctagagaccactctagtaactggagagccttggtgtagagctgatgataaaacctgttcctgcttttgtcagccatgaggagcatttcctttctagacagaggaactgaaacccacatgccagcccaaatttaccaaaagcagtcactggaatactcatcacaccatcatgtctcatcttatccctttcgttaccttcaaatacggccccatttcctcaggaccagaactcccttatgtgggcagcaggactaaggcccttgagttacctgtagtgactcctcatcaaatggaggaatgtgccagtattttcggcaaaacatgaatctgatgaaacactgactgaactgtctcctagtttcaaaacaaattattaccacttagggcctctatttagggcaatcagagtcagaagtgggaacgcatcttgtcctcctaccttgattaacagtaactctagttgcaggatgatggtcaaatcctctctcctctaatgtgcagttgtgaaggatttaggctccactgctcctgcatttgggtggggcctgaatcactttcagtctagcacaggcgggtcacttcaggccttcccacctccatcagcatccttcaatcctcccctgacatctctcatttatgcttcctattgattcagagatcccatcccgagtggctaaaagaaacattcattaacctttctacaaagtcatgaataatccatggattacattgaattcatccctactaaaaccatcttcagaaattcagatgtagtaaccttctttctgaatttttttttttttttttttttgagatggagtcttgctctgtcacccaggctggagtgcagtggcatgatctcagctcactgcaagctccacctcctgggttcatgacattctcctgcctcagcctcccaagtagctgggactacaggcacctgccaccatgcccggctaattttttgtattttgtttagtagagacggggtttcactgtgttagccaggatgatctcgatctcctgacctcatgatccgcccacctcggcctcccaaagtgctgggattacaggcgtaagctaccatgcccagccaagtattctattcttaatgaacacatatatgcataatatatctattttttataatatatatatttagaattgaatgtcagagtacatatcagtgttggaggaagggaataaggaggaagcacagaaagtaaaaaggaaaaataggcaccaaaaaagatttggagaatggcagatggccaaggagatgcagctgggaagtgcctcttccatggagaggaacataatatctagtaaaccttcacattttaaacagatcttttgagagaaaacactgaaagttgacacagaggtgacacagacaccatggttgaagagggaagaaatggggcagtctgctcagagtcactagacaccaggactggcccatataccctgaacaaacccaaggaaggggtgagtgaagaaaccctgggacactacatacccataatgtatctctgagatcctagttacaggagtttctacgaccctcatagatctttggactggtaggagagctgcctcgagcacatgcagaggcacagtttgaacccacacagagcccagaaggctttgttgtgctgtgcagctgcagcaaaatgcaaccctaggtgcccatcccacaagtctccatttcatactgagtggctaagttcctgctgtctgccaggctgggagtgaaccacgcctggccggctcacatgcccaagataggccccatcaccaatgctgtgtgattaagttgcatctggtccacatgcccccttgcctgtcaaccccttcccagacctcatgcctggtcacgcctgcaagagggtgtccacagcacagcatccactgcatagcttgagtgttttgttgacagcctgggaaaagctcaccaccctgtccccaaatcacagccagtgcttgaagcttagaggccagaggacaaatccgtgagcccagtcccaactccccaagactcaagtataccacccagggacattgagctgagatttgtaacctaatctcaagtgaaggaggatcctccatagtcagaatgcagagaagggtgtggtatgggttctcatgggggcatgggagctggacgcccctccctttgcaagaccagaccatgaagggtatggcctgatggtggtagcttctttcccagggagtgtccttgcacagaatgcctggagcagctcaacaatgtgggagcagatagcttggggaaagcctagttggttgggcttgccgccagggcgagtgtctgtgggagatctgctgggtcaggggagtgtaagctaggcagactccatggttgcctgctgggctgaaaatcatgggctgcagactccatactggtgttgcacccattgtgccactgccctgcctggagatcctctacccttgaaatactgcatcatcagagcaactgcagacataccctaaaacctgctctgactttggtaagcacagtggactggtgggtctctggagagttgtgtgtccctagagatgtaatcctcagtgtggaccatccctaggggaagggggagtgcagcctgccaaagcacaacatgagacaaagaaaatgcgaccatggcataagccactgaaaggagcaccaccaaggcccagaaccagacttggagaaggaattatgtctcacctccatctcccctccccagtgcactgttgcagatgcaaaaatagctcttcccataggggcccagaaagcatgcactgaaagaagttgtttctcatgattctccagtgagggcaagcatgcaccaagaccccacctgccagctcttactcttaagtccatctaccagattgaagtttgagttataccatcatataaaaatacattgctaaaacaagcaacatctgtgaaagccactgcagcaacctatctgtaaccaaggaacatatatggaaacttcaccgtctgcaactacccagaaatgaagccaatcaatcacatacaccacagtcatactttcaaagagaataaaaaatataaaagccctgtgatggttaatactgagtgtcaacttgattgtattaaagggtgcaaaatattgttcccgggtgtgtttggagggtgttgccaaaggagattaacatttgagtctggactaggagaggcagaaccaccctcaatctgggtgggcaccatctaatcagctgccagcatggctaggacaaagcaggcaggagaaggcagaagagcagacttgctgagtctcctggctttcatctttatcctgtgctggatgcttccagttcttcagcttttggactcttggacttacaccagtggtttgccaggggctctcgggccttcagccacagactgaaggctgcactgtcagcttccctacttttgaggttttgggactcgaactggcttccctgctcctcagcttgcagatggcttattgtgggactttaccttgtgatcatgtgagtcaatgatccttaataaactccccttcaaatgtacatctatcctattacttcggtacctatagagaactctgactaatacaaaccccatctaaatgaatcaaattcaaaaaagaagtgtcaactcccgcagatggaaaggaataagcacaagaagtctggcaatacacagagccagagtgttttgtgatctccaaagcctctcactagctccctaggaaaggatcctgaccagatgtaaatgtctgaaatgagacacatagaactcagaagatggatgtcaaggaaagtcaatgagacataagacaaaatagaaatccaatgcaaagaaaccagaaaaacagtccaagatttgaaagacaacatagttatattaagaaagagccaaactgaagttctggaactgaaaaattcactaaataaatttcaaaatatagttgggagacttaaaaacagactaggccaagcagaaggaaacatttcaaagcttgaagactgattcttcaaattaacccagtcatgcaaaaataaagaaaaaatattttttaaaaagacaaagccttcaagaaatatgggatcatgtaaagaaaccaattctaccacgtattggtattcctgagaggaaagaaagagtaaccaacttggaaaacatatctgaggaaaaaattcaagaaaatattctcaattttgctagagatgttgacatgcatacaccagaaatccagagaacccctgttatatactataaagacagccatccccaagacacatagtcgttagactatctaaagttaacacaaaagaaaaaacaaatctcagacacagctagagaaaagagcaacactacctacaaagggaacccatcagactaacagtggacttctcagaagaaaccttacaatccagcagagattagaggtctatttttagtactctaaaaggaatgacattccagcataaacattcatattcttcaaaactaagcttcataaacgaaggagaaattgagtctttctgagtcaagcaatcggtaagggaatttatcaccaccagactagccctgcagaaatgcttaagggagttctaaatgtggacatgaaagaacaatacacagaaaaagcacagttaagtacatagtccacagactctataaagcaactacacaattgagactgcaaagaaactagctaacaaaactatgacaggaacacaatctcacatatcaatgttaaccttgaacataaatggcctaaatcctccacttaaaagacatagagtggcaaattggaataaaaaaatcagaatcacccatctgctgtcttcaagagacccatctcacaagtaatgacactcatgggttcaaagtaaagggatagagaaagattaatcatgcaaatggaaaacaaaaaagagcaggagtttctattctcatgtcagagaaaacagatcttcagccaaaaacagaaacaaggacaaaaaaagttattgcataatgacaaagggctcaattcaataagaataattaactatcttaaataaatatgcacccaacattaattggagcatcacgatacataaagaaatcactactagacctaagaggtagacagcccctcagtaataactgggaacttcaacactccactgacagtggtagatagattattgaggcagaaatctaaacaaataaattctggacttaaatttgccacttgaccaattgaacctaatagacatctacagaatactctacccaacaaccacaatatacatatatatttcccatcttcacatggaacatactctaagagtgatcacatatgcagttataaagcaagtgtcaagaaataaaaaaaatcagataatatcaagcatcttcttggaccgcagtagaataaaaatagaaatcaatagcaagaggaactctaaaacacagacacgcacacacaaacacacacggaaactaaagaaattactcttgaatgacttttgtttgggtaaacaataaaattaaagcagaaatccaagaattttttaaacaaatgaaaatagagacacaatgaacaaaaacctctgggatgcaataatggcagtttaaaaaggaaagattatagtgctaaatacctacatcaaaaagatagaaatatctcaaattaacaacctaacattgcacctaaagcaagtagtaaaacaagaaaaaaaactatatccaaatatagcataagaaaagaaataacaaaaataagaacaggactgaataaaattgagactcaaaaatccacacaaaggatcaacaaaatgaaaagttggttctttgaaagtgtaaacaaaattgatagactgcaagcaagattaacaaaaaagatccaaataagcacaatcagccataacaaaggcgacattcactcgagtcccacagagattcaaaagattctcagagactactatgaacatttctatgtgcacaactagataatctagaagaaatgaatacattcctggaaacacacaacctcccaagattgaaccaggaagaacctgaaacactgaacagaccaacaatgaattacagaatgaattgaataagtaatagaagcctgggactagatgaattcatagctgaattctaccagacacacaaaggggagctcatgccaatcctactgaaactattccaaaaaatcgaggacgagagattctcctctgacttactctacaaaacctatatcatcatgataccaaaatatggcaaatactcacacaaaaaacaaaaccctaggccaatatatctgatgaacatagttgaaaaaaatcctcaacaaagtacttgcaaaccacattcagcagcacatcaaaaagataatacaatatcaagtgaactttattcctgggatgtaagggttgttcaaatatatacaaatcagttaatgtgattcaccacataaacagaatttaaaatgaaaaaaaaaaacataagattatctccacagatgcaggtaaaacatttgataaactccaacatgccttcataattaaaaccctcaatagactaggcattcaaagaacatacctaaaataataagaaccatctattgacaaacctagtctacattatactaaacaggcaaaagttggaagaattcccataagaacaagaacaatacaagaatatccactttcaccattcttattcaacttagtactggaagccctagccagaatgatcagacaaaagcaagaaacaaaaggaatccaaataggaaaagaggaaattaaattttatttcttcactgatgataggattctatacctagaaaaccctaatgattctgaccaaagactcctagagttgattaaaaatttcagtaaagttttaagataagaaatcaatatacaaaaagcagtagtatttctatacaatgcaatattcaaactgagaaccaaatcaagaacacaatcccatttacaagagccacagaaaaaaaaaaagaaatacttaggaatacctctatccaaggaggtaaaagatctctttaagtagaactacaaaacactgctgaatgaaatcatagatgacacaaacaaatggaaaaatattacatgcttatggattggaagaatcaacatcattaaaatgtctttactgcccaaagcaatctacaaattcagtgcagttcctatcaaactgccaaagttatttttacacagaattagaaaatcaattctaaaatttgtatttaactaaaaaagagcctgaatagccaaagcaatcttaagctaaaagaacaaaggcaggggcaacacattacctgacttcaaactatactacgaggctacaataaccaaaatagcatggtttgggtacaaaaatagacacatagaccaatggaacaaaatagagaatccagaaatgaagtcccatacctacaaccaactgatctttaacaaaattgataaaaatacaatggggcaaggataccctattcaattaatggtgctgggaaaactggctaaccatattcggaagaatgaaattagactcctgtctctcaccatataaaaaaattaactcaagattgattaaagacttaaatgtaaaactttaaactataagaagcctagaattagacctaagaagctcttttggatattggcctatgcaaagaatttatgactaagtactaaaacacaaaagcaacaaaaacaaaagttgacaagtgagaccaaattaaactaaagagcttctgcacacttgcatgttatattgcaaatatgaaatagcaaagacatggaatcaacattggtttccaacaatggtggattggataaagaaactatgatgcatatacaccatggaatactatgtagccagaagaaagaatgaaatcctttcctttgcagtaacatagatgtgcctggatgccatcatcctaaatgaattaagatgtaaacagaaaaccaaataccgcatgtcctcacttataggtgagagctaaactttgggtacacaggagcaaaaggatggaaataacagacactggggcctccaaaacaggggaaggaaggagggcaaggtttgaaaagctacttattgggtactatgtttactattcagataataagttcaatagaagcccaaacctcagcatcatgcaatatgttcatgtaacaaatgtacacatgcatgcttaatctaaaataaaaattaaataatcaaataaaatgatttccatgaataaaatggtagatatgattatgtggaaaatgctttactatttattatgtggtgaataatttaataatatttaataaatacatgaatgaaaaatagctacaactgtgtgttaggatttcaataattttttatttcattcctaataacttttatgtattattatatacataataatatatatagttaataataacaaaaacaacatggtattgaaataatttccacccagacggaggatcaacatatttaagtgattacactactcaagataaaaatcatttatcaaacagatcaaagtcatttacctgctttcctttttataggtcctaggaacacacgtgccacagacaataaaacatcacttcccccatcccactactttggactttatttaacatctttgggtagaacagaaactgttgataaggtgagttttgttttatagacaagagaggaaaatggatactttgtgtggtctgggccttagaaacagactaagatctttttttttctattttgctttttttactaggataaaatattaattggcaaaacatcgaatacaagcttcactatcataaaatcaaaacatttaagcaatattccaaaaaagatttgacaaaaactagacaccaagagtacaaaaattacacatcaacacaaagcataaaaaatgtgaactttcaaattaaacagtcaaaaacatgtacctgcatgatcacctccacaccttgactgccttcgtctgcagcacgctgctggtaaaggctgggtggctgcaccgtcgtcccctaacctaacattgctttcatctgtgaaaattcgcttgatagccaattaagccatggaggctattacatttacacggaggctacgcacaatctcaggggaggctcaaacagcagttcgttcctcacacgcactgttgggtgcaaagggcacctggagagtgagggagacctgggcgctttcctgcggggccttggccacgcggccgtcgcccgcaccctgtcccttgcctggcaggggacacaatatttgtacagattatggtataatttgaacgatttcctaatctacttatcttaatttatatagtttatttaaatgtcaaggcagagaaatacattgctcatgttaaggtcacgtgatgtggtggcgcagtaatgacttcctgaggaaacagagaaattggatgttttgtgatttagctatgtgcactaaacttattttccatgttttgagagcacattaaacattcacgtacaatgtgggaataggctggctcgtaaccaaaacgtccaacccagtgccaccctttgaatcgctgcgaacaccatcctattgcggttcagagaaaacaagcaaggctgcgaagcccgggggttcaggcagctgcagcgcttgggccaaggtagctccgctctctggtctgaagccacgtggccccaccccggggcggcctggcttttttatattgcttattgctgtgtttggcatgccattcaacccatcgggatgttggatagtgacttgagagcaatacctagatttgccctgtcgggatgttgcatactgagctcggaataagccctgctcaattgaggcactatcactaggaggaggcactgattcccgcctttcaatgctgtctattggtgaaagaggagttggatggcatctgggaaattagtatcacttctactttttcttcttttcttttaaaggttaaaaataccttgtattagttaatactgctataaaatatgaatatccaaatctctgtggctcagtaaaatagatttttttttcactcagagaaagttcaggtccacccttagtaacccaggctgacagagactcttccattttctatacatagcttccccaattgcccagagaagagtggaaagattttataggtgactgtacacaagaataagaacttagtacctagtcactaatttactcgttgaataaacatttatggagcttaacatattaatcactaggcagacgctgggacacaagaaaaatctttaagatatgtcactgcttattaccaataatgttctagtgagtaacgagagttaataatacgactaattatagtattgtaaatataattacagttccaataagacatacacacacagagaacaattttatctggtggttgaggaaatctttattgatttaagatatcttttgatgaacaggatttttcaataactatcagaaaaagaatgtctatgacttatttttaaaaatgattttcttatctgccttgcatatctgacactttcatctcctatcttccttgaatacaatatagaacctgacatttctttcctttcaaagatccttagagcatttcctacatttaatctgaatgtctttctcagtaatttttcctatacaagcaattatggctacattttcttaatataatcatgaaaaggtgagcaaaactgaaaatttaatttggagaatagatacgaaacatattcaattaattcaagttgttgttaggctgcatatgttcagctttcagtgaagatgaacaaatgatgataaatgagaaactgaaagaaaacaaaccaataggtgttttttaagaaacaatattattaaagtgcatgtgttttctactgaatgaaagcaacatagaccttttcctcacattggtagttagtaagatatataaaaacaactttgtaaagaacaattaatacaggttaatgaatcattgtgaaaaggggataacacactttattctaggaatgatctgcaaggtgttaaaagttaaaaaagatgaagaacaattgagtagttatttgatcatagtgtttattaaattgcttttcctgtatctggaaagctttacagaaatgtcttcaacagaataactgtgttaaaagccaaatgaaatgcattatgaaatatgattcttcacttggtgtgcaggtataatctcaggtgtaattcacacaaagagacaaattcaattttaaagttccatttgttacaatttgatgattgtgattaaagaaccataaaaattttatctttgacatttcattttttcctcacaaaagcattctactgtaattttcttagttttctttcctcttaactgtggtgttacctataaatgctggatttctctgttttacgtgcaacaaatctacaatcaactatttctggaacaccacttcatcttaacaacaaggacccataaatattttaaaaattcaaaatgttatatataaaacgctaaatgatacacataatacatttctaagtagtaattatgattatgcccataattatacccataatttaaaaatatgttacctgaagtaaattattatacattttatgttggaagtgttcatttatctttgatctctgttaacacattgtactatgtggtaataatataaactgccttactggatagtgatgtatctttggtttcatattgttactggactaatattccaacactatagatagtgaaatttaacattgaaacaatttgataatgccatcaatgaatccagtttttaagaatgggatccattttctaaaattgagtatatagatacttcatgagatatcttatcatgcatcctaaaccaaaccaacctcttcccctgactgtcttacagtgtattattattttatccaccgcagcaactagtacatttttcagaacctagtagatattcagtcattgtctatggaatacatgaacacattctgaatttggacagtcatcattcttggtgttttaaaacaaacacttcctgaattgcatccactattttctaagaagccctaggaattcattgaaggagggtatgggtaagttgggggtgaaactgtaaagatgtaggtcctcctcccaaaacttcttcagcgtatcttcattgctgtttgtttgtttgcttgcttgcttattttaaaagagatctagatatagtctaataagaattgcataaatgtgatgttccacaatgattctaacttacatggtgcaaaataataaaatattacattctagctgtttgtagaaaaccatggatactataaaggatctagattttctctctcctttcctcctaagatttattcactcagcaaagacttacctggtgactacttagtgctagacactgttttagatacttgggctataacagtgaaaagaacagtaattgaattaacgaaaagttcattttaattagctgtatggtaaaataggaaactaacaaaaataaaatataacatgtcaaatggcaatgactgctctgagaaaaataaaggagaataagaggttctaaattattatatatggccaatattaccaacatattatagaaagcaatgagttcataatgtttatcagagaattccatgaaaatcgctaaatttttctagaaagccaggcactgataagagaataaacaaacagataaccgattttaatttgatcttctcttacaggtgcagctatgatctgccattgtatataatataaaattaaaaattgtttatatttcattcacgttagcatataatgttcttacttttttttttttttgagacggagtcttgctctgtcacctaggctgaagcacagtggcacagtctcagctcactacaacctccacttcctgggttcaagtgattctcctgctccagcctcccaagtagctgggactacaggcaggcaacaccacgcctggccaatttttgtattttattagagacggggtttcaccaaattggccaggctggttttgaactcctgacctcagatgatctgcctgtgcctcggactccaatagtgctgggattacaggcgtgagccacagtgcccggccaacatttttacatttaaatatcagacatctatcagattcctttctccctactacaaacattgtatgcttttcgataggcataagattttgttttcattcaggttggattcaacaagtattatttagcagttcattgcatctatccatttacccaatagaggaagtatacaagatacaaatgaataaagtgtaataattcttatactatttgcccttatgtcatgtaactgctccatgtttgtattccgaaaacctaactgggagggaaaactcagaaaaatagaataaaaagtattatatatctcatacatcctcattttagaatattctaggggtacagatcagtataaataaaatactctggtaagtgcccaccacatcatctgtttgtcattcttagacccagagtataccattcttttaagaaagaaaacttgctactgtacctcctacccagtaacatatatatcacatatcatatatatatcataacatatatatcatatatcatatatacacatatcatatatctcatatatataacatatttgctactggttaggagtaacactcagaaaatcacacttaataatgtagtacaattaggtataaattcacttagtatttttaaattttacgtgtattcctatttatatgaatggtcatttaaaatcacatctactgatcctgatagcattaaaggcataagaggtactgaggatattaatttaattttgtttacagctatgcacagatatttttagttcactcagatttaatccagtagtctattatttgattaattgtacagctatcaaatcattcaggactcccactgtttcaacaacgagtggaaaaatattttttcatttatgtttatatgcagctatttgtagtctaaattaatatcctagcaattgatggtgaaattaaaattatttctgtcagatatggtaatttgatgacagtggataagcatgggagtaaaagaaagttttggggaagaggggacagtttttgtttacttaatgattattccaaagatgttaagtaaacattctatagaatgctacagatagtggaatacagcattgaaacaatttaataatgtagtcattgagtccagtttttagaaatgggatctattttctaaaactgagcatacagacacttcatgagatgctttatcacgcatcctaaaccaaaccaaccccttcccttgactgtcttgcagtgcatagggcatctctacactctaggaaagaaattatcaatctgtttatatgccacttataaaatcatacttaatgtacgattaggcataaatttacttgcatttttaaattttgtaaaatgttaacggtaagtgttcttgaaaaatatttctgagaatattttccaaaaaatgaacaaattttaatacataagggacaatatctttgtagtgaattgattatcagagtgtaatgtggtatgttctgattatgttacataatattctgattagcagaaaattctgaataagtgaatttagcaaaatgtttagaggtcaagaaaactgttttagactgactatgttttctgacccaaatgtaagaaagaacccaataaaaagaggcagccagataatgctgttgtttgcaaacttaaacagaagcttgcatgtaatttatgactcaaagaaaaataaaaatagaagttatactttatttagaacttaatgacagtgaaaaattacacataaaaaggaagactgttgaatacagcaaaagctggaattatataagaaatataaacataaacacacaaaataagtgtaaattataatgaagtaaaaatatatcaaagagaaagaaggaagtagtacaataaaaaataaagctgattctttaaaaaccatagttaaatagacaaatttccagccagattgtttaccaagtaaagagaaaaagaaggagatagatcaaaagacacaagatggtgatgaaaagagggttagcacttataaacatagtagaaatttaagccataatgagcacaagaaagcattatcaacttacttttgaatatataaaataaagacacttaaaaaaactgaacaaaaatgacttactagttttaaaagaaaaaagaaaaaacatcaaacatctatccttccaaaagtatagacttcaaaagtatagtcccagatgggtgaacataaaccacactttaagcaagaactctccattataactgcttgcaattttagaggataccagccacactcctgaaccagagcttggcactggctattccctctggaacacccttttatttccttctctaagcaaagacatggaatcaacctaaatgcccatcagtggtctgctggataaagaaaatgtggtatataaacaccatggaatactatgcagccataaaaaaagaacaagatcttgttctttgcagggatgtggatctagttagagaccattatccttagcaaactaacacaggaacagaagatcaaacactgcatgttctcactcataggtgggagctaaatgattagaacacacggacacatagagtgggggacaacacacactggggctttttggagggtggagaactggaggagggagaagataaaaaagaataactagtggttactaggcttaatactggggtgatgaaataatctgtacaacaaaccaccatgatacaagtttacctatgtaatgaacctgcacttgtacccctgaacttaaaagttaaaaatgaatgaagcctgtcagaaccacccatttagcagtctaacattttccctagtattcccaaacccctttgcctagccaacattttccacagcactttttgtcttcaaactactggcctgaagcaatctggcttagctttctgagtagctggaattgcaggtgtaccagtgtgcccagccacagttttttcaagacctgtttaagataacaggttagagaaaatcaagataatattttgagggggaagaaggtaaaatcaattaagacagggtgcacagagtacttgaatggtacagataatgtttatcctttgtactaaatggtgtgtatgtgggaactgattatattattttgactgtttgtagtcatattatatacatatgtgtataaataaaaataaaagaaaaaatataagctaaatttatagatatattaattttatttaaatagaacaaagatatgccagtattcaaatgtctgcaatgattcttaaaatgcacagaacctgtgtttaggtacagtatcacactgttcatccaggcttcattcactcgaatctactcttatctaaaatttgtactgtaagtaaaattacattctgtatgacagaaagcaaattataatattagaacaacattatggaaaattggcataacattgtacaatcatccattactttattatttatcattttgcaactttttattatattagtaaaaaaagtctaactgtacttaatagctaatacatatgttatttgatatttttaaagaccattattaaaataataataatttgggggtgagaaggcctattgaaaaatgaccaacgtggaaatcataaataagtttgatgcaacaaatatttgtgagtcttatagttaaaaatgtaaaaattcattataaacaaagctaaaagacaataatatgcattgggaaatatttgcaacatttacttcaagggttgatgtccttaagagaatttttacaaattaataaacatttaaaaaggtgaggaatggcaatagctatgagagacaatttacaaaaacataaaaaatatgaaaactgtttaatctgtaagtacatcaataaaaattttattatagtagttatgttatctattaaattaggaaaggtcaatacaattggtaatcttccaagcaaatataggggagaagggctttctcatacacttataagaatattattttgttagaatgcaattaaataaacacttggtaaaaatctatatcctttgtccaaacaatttcagttctagacctctagaatccacatatacatatacatatatacatacatatacacacacacattcatacctatatattaacaactcaaatccagctccaactcttttgtaagtagtattttgtccaacaaataaatttatctcaaattcttcttgactttcctccattatagagccagcaattctacgtgtaactctacctctaattcctttatttgcatttatttctgctttcaaacccttatatgaggcaagtgggattaatttatttcattaccttaactagattcattgctttactttgtcaaactctgattgatttgctcaactcaatcttatgtgttcaagaacttaatgtggattcctgttccaccttatgaaagtcttttccaaaaacttgctaaattcttgactcaagacattccagtcagtaatgcatttctctcctcaaatacaatggaactgtgttctaataagtactcttcaacaatgtgcagttatttctccacaactatcaattcccctttaagcagaattttactaaaaatggctttatccttctggggataatcagtaaaatggcaattggtgggcgaattaaaaatatattaaaagcagatggcagaacatgagtgcagatttttactacaaagcttaggaaaagcaaaaggaacttgaatagagaaaatgcagaaaagccctcctttggctattaggacggagagagcagaagtatgtttagagcttcaaagagtctgactctttgcaactgtttatcttaggactttaaggaagtaaaaggtgcaagtgaaacactctggattataaaatagaatctgacacagaggattcaacccagttaatatgcatgttgctcacatggaaatgctgagaaatttttagcaaatagatagaaaatgacagatggtaggtatatagaaaataattgtaggaaaaaatgtaaaatgaagacgtatggtattccttttatattttattttgttaatatgttgcccatattgctttatttcaaagaatgcaaaaccaaaaaagtagttccttcctaacttcccctgcagccttgtcttgtggagcttgtattttacttcatgagaaatgccaaggagatgtcatttaagctgaaacctccagcagaattagccacaatatttgggaaaaagatgtttccagaaaaagaaagagctagtataaatgtccttaggcaagaaggagctcacgatgattgaggaacaacaacaaaaaagattatttcactcaagaaaagtgaattgggagtacagatataaatgatgaggtctgaatatgattcatggggcaggtcacactagggtgtttgggtgtggtctaaatgaatgcgcggcatgagttgttttaaggagaggagtgacatgatttgacaagttcttaagagatccctttgattactctggggagaatagaaataaagtagcagaaatgaaagcaaagggagatagtaggaaataattgcacatttataagcaagaaatgatgttggcttggactctggttatagcaacaaataaagaaaaaaggaaatactgagaaaagttgattggatttgctgacattctcaacataaatggaagtcagtatttttttctaataaatataatatgcataaatatttttaaatatttaattcttttaccactaatggggcacgagtagacttcagggaacatgccagtacagaaacatataaatgtgatcattggtagagataggaattaataggcatttgaatctctccctcaacctggaataccacaaataaagctctttgcttttcatgttgcattgttatcataccctatagttttctgccattttcagttacttaatattatgttttgcctcaatagattatagtgctttctcttgttgtgttatatttgcagcaattattagtgaagttttaaacttcaatatcacatctaaaacaaaacaaaattgttgcctactattttccattaaaacatgagaccactatgacaaaaaaagctaaacgtgtcatgaaatgacttacattggatgaaagtatatgcaatatattaagaaataatctctgactttgtagttttttatttgtagtttttactagaacatgaaatcaatatgtgaaccctggctggagtttgcatctaaatgtaataaaataaaagaaagtttaatattatcattgaagcattaatgtacattagcgagctggactatataaaataaactttattatatttagcatttgatttttatttatgtatattataaaatgaatatagtttatattataataaaaataaaagaagtagtatgttaactaattagtataagatgcctacaaactacatatctgcctaaatttttgacccatgaaacttcaatgatttgtgttaatgttaaggcctacatttatttatatatatatatatataattaggggaggaattgttaattctttcattttaaaaattttaactttgcagacaaagttgactatacctgtggcagaacactgcaacagctataaataaataaataaataaataaataacttttattttctgtggagctcccagaattatgaattattctgtagattgagatttgccaaggtccttttcttagagttgcaagagcataggagaaagtcaagggaaataataagcagcacttgatttcctttaccacagtggatgggcttctaaaaccaaattacctgactataaatccagatctatcttctgcaggctacgtgattgtggatgttacctcttctgtgcttcaatttcctcatctgtaaaatggaattatagcctaccctattttgtagtatagtgaggataaatagaatgaatgtatgtagttcttagaatagagcatggcacgtgataagtggtcaataaaatattgtttactactagttatgtaacagtcacttcacacataataatgatttaataaaggaataagaagaatgtagagcacagcttctcaacattggcactatgacattttgggtcagacaattatttaatgcagagggggctataggatgcttagcagtgtctctggccagtagcgtacctcctcctctccaagttttgacaactatcaaaaaggcttctagacattgacaactatcccctgaaaagtaaaattgtccctgcttgagaacacaaatataaagtaaccactcaaagattacattactaattttaattgaatttgaccagcattatgaaataagcataagcttaagtttctacccttgattttgtcattgtcagttagggcagcagagaactccaattctgaaaattctgaacatgtgctaataccctataatataatcaaaactttcatttttgaattgtatttcttaaaaattagaaaatttattaagcagcaacatggaataattaaccacaaaaatgttgaacataaatctcatttgcctaagttctcttttgaagtcctatttcactatataagtattatgtgttttgtttcacagctagataacagccagttttttctttgagcctaaggttgcttctcaaatttatggtggcttatagctcttctaagtttctataaaacttcagcaacctgcagcaggttgaaatttattgatattgagttattcaccaggtcatattacaaagtcagggattgactcacccaaaccagatgctccccctgccaccagatcactaggagatattgcaatcatttcccctggttactaaattagcaaaaattctcagggagagagaagggcaagatggcacagtttaatacttactattattcttttattctttaccatcattccctttgaatggattaagaatctgacataaatataacttgctaaagaaagggtgttaggtgagagggaagtcatattggtctaagaaaagtcttagagaaatattttgaaaagaggcagagagaagggttggattggagtgggtgggtggggaatcacactaaggagatggatcattcataatttctttagacatggtgaggcagccacaggagtctgaacttgttgaaaccctagtctgaagccaataaaagtgctcaataaggtcatactttgatcttctctgcctaaagcagttattcaccctatctttgggagaggaaacatctacaaacctttgttctctttgttagcagagggatgacatgaatttgggaaaaacgtttgagagacaaaatgagatttagctcgagcaagtgatcgacttgtgctgggttgcaaatggacttttccaacaggcagattgaaactgtgcttcagcaattaggataccagatataaacatccatgcacagaattggaaaggttcagctttcatggttgctatggtttgaatgttccctccaaaactcatgttgaaacttaatccaaaatatgacaatatagagaatgagctttttaaagaggggattggatcatgaaagttcttccctcatgagtggattaattcattgataagtcagtggattaataggttatcttgggagggaaaccgttggatttataagaaggggaagatagacctgagctagcatgttggcatactcagccctcttgccatatgataccctgtgctaccttgggactcttctgagagtccccacaagcaagaaggctctcaaaagatatgccccatcgaccttggatttccaagcctccttggctgtagaaaataaattcagttctttgtaaattactcagttttaggtatactgctataagcaacagaaaacggactaagacaatggtcttatccagaactttgtaaactagaattgcctgtttagattcagtatgtattttttttacagatgcaaagtaattttgttttgaactgtacaatgaaggagtgtcataagcttttccacatgtagaggctctaaatatcagtctggcattgtgataaagcagagagtttaaacccaatcctatttgtgccccatgaacgttctttctggttacagttcagaaaaataggaatggatgcgtaactcaaggagaagcatttaatacatgaggctttttctcaaaattttgatttagaaaatgaggtattttagtatgttaattataggcatttcaactgagaagtctaatagcattgggccagaattgttgcagcagtccaaagccatggataaacttaagttaaagggaacaaatactaacagccttccaaattaatctgtattggagaggatgataaacagatgaatgggaactagaaaccatgcagacttggaactagatataaaacaaacagctatctaatgattccttatttactctgagcccaagatattcttgtatccttttagttaaacctctgttttactaaggaaatttaaataagattctgtctcttgcaagaaaataacatctaagacatcttcgtatttaatactgccttaattttgtttacaccagtggtccccaacctctttggtaccagggattcgtttcgtggaagacaatatttccatggacagggttggggggaaggtttcgggataaaactgttccactactcagatcatcaagcactagattctcataaggatcaaactagatcacttgcatgcgcagttcacagtagagctggtgcttctgtgagaatcaaatgctgccaatgatctgataggaggcagagctcaggagtaatgctcactcatccacctctcccattctgctgtgtggcccagttcctaacaggcccagtaccagtttgtggcccgggggttgggacccctgttttacactataacatttccacacgtctctcatggcctttcagatccactgcttgtctcaactcaagtccggctacctgaaaattcgattattttttcaaagtgaatttgaatatctttatgttgaatacacagtctccacttttacgcagcccctactgtcttatatcatacctctctagccctggaagagatcaactttacattcacttttcctgttttagggctattattttatcttcaattatcaaaatctatctacatttagatactttaacttgcaaatacatagtaaacaattacggattatttaaaatagcagttttcccatgagtataaaaaaaaaagaacaataaaagcaatatttgttgagtattttaaagtgccaggcactgcgcagtgtgctttgcttaagtaaatgtttgacaaaataaaaggtcttttaaaagttccatgctttaacattaataaccatataaagataaggttagactttctatcaaattagcagttttgtgaagataggccttttctgctatatagaatctcctcaaacctgagtgttcgtattatggattatctagtatactccatagctatcaagtttgtgtgtgtatgtttctttctcaagcaagttatcttatttctccttatttcttcagacttatcctttcttttcttttcttttcttttttcttttttttttgagacggagttgcactcttgttgcctaggctggagtgcaatggcatgatctcggctcatcacaacctctgcctcccgggttcaagtgattctcctgcctcagcctcccgagtagctgggattacgggtatgtgccaccacgtccagctaattttgtatttttagtagagacggggtttctccatgttggtcaggctagtctcgaactccacccgcctcagcctcccaaagtgctgggattacaggcatgagccaccgagcctggcccctaacctctcatttctaaggaaatgacaaattaagtcttttatgaaaatacagtgtagggtcatttaaaaatattttttgtaataggtgtctctgtacataaatctatttaattttttctcttttacagtaaaaaggcaatactgtgttttagtttcaccaaaaatttcagtagaccaattgtgtaaagggatacatttatatgaatttttttgacatagtaaaaactaagaggggaagttattcaaatatttcagcataaattccctttccttgaaattgcaatcatcatgtgtagctacaattcctcagcattcctctgtagtttagatattcccaaatgtctgactaataactctatctataggcaactgttctgaaggtttaaagtaaggaggatggggttcatttagaaccagtgggaaaaaatgctaatgctgggctttgaattttatggatgctgtagctgttatttttcaattaaataaatgtttatatgccatgttttgtagctatcgcagttaaactgccctcatctttttgcccagcaaaaaacccattaagatcttcactgagattgagtctaggttttttataaaattaataactgtgctactggtttctcaaaaatgagtagaaatgacttttcaatgcaaatgccagtttttgatacagtgaaattatcctgtctgcagtgactatttgaacttttatcggcaatcggacactgagagacttagtatatgaacagatttatccttagattatctaatacatgctttgcaccctgcaccataaaacctgatctatttttaaagccttggttgttctgaaaaatgaaatgaaattgtattaaatggcattttgactggggagaaaaaaaaaacttcatgtggtttaagagaatggatgccggcaattgactgtctactgtttattcaaaacctatagattagcagccagatgtggcagaaattggctgatttttcattcacaacaaaaacgatgctgtgcttaatgaatggaggtttgttatcccagtaataagtaaaaggtacatgaaagcccttgtgtttaatgttcatgcaaataagctatttgcaggtggcttttgggcagggtcaaatattttcaaatatttttcaaaactgggtcaagttttttaattgtcaaaaattaccagctagaggaaaacctcctaaaaactttattatgctatttcccaagtaaatgaaatgacaagtcacttatcatttaataaattacatatgaaaattcttttccttatgatttcatcaataaataaattctagaggattctagatatatttatttggcttcttttttttaatgtggtatcaaattttgtggatattctttagagaatcaaattcttaaaatggcattgaacatttaatttaaaatgcccttcttgaaccatacatgtttattaaaaaattattttatataggttatccattaaaaaacaattttctatatatgtaaacatttatgataactgctcattattttggtccatacttatttatctacctatttattaaacaatacaaatcatacgctttgtaaaaataaaggcctagtctaatattactctctgtcagaaataaaataattcagagaagtctgtattacaagacaaaataaaacaaaatagaaaatgatgagaatcacaaaaccattgccaaatttccagctatgatatttactctccatgtggccttaggtatcttactctcttattttaacctttctttgattactgtaaaaataatttgttactaagaagccctcttgctttagtagctgtgagtataaaattaagaacataattctcaaaaagtgttttagtcttcctggaaacattttaaaatatcaattaatcattgaacaatatacaatcgcctgatcatttgctaagagagggttgcattctcatctctgttcacttctgtcctttctgagactcaaacaggtatgagagctagaaaaaatattaatgtgtagtaattcaaaatttctcattcatgaatctcttcagcagtgcaaagaatactttgtaatttttaaaaggcatttttattaatatacttctactattctaccccaatcaacagcaaatttacctaaatcatgagactactggtactgctaatttttagaaaagaatgacataagaactactattaaacccaatgaatcctttacctgaaatgagaatgtccacgagtcagctcttctgaccctctggccagtgttctggagttactgatctccaactttctaattgaactctagcttggtatgtgagagcagccatgggtgaaccagtggagcaagatttaagccttgacattgccattaatgattcaccacctgttgcaagttcaataagttatccacacaccaaattgtggtcgcagaattcagtgagataaactaagttagaaagatttggggtgaataaatgtttgctaaatcagaattgttaatgatagaaatctgtatcttaacaaagttgagaaatcttgtcttcttaacgtgtatttattgacttcccaggatatgtcttagtaaggaaacatagcttctggcatttattattagagtgataaggaataataaaccacagtgcttgagagacagggaaaggcagggggacctagagacacagtaacagaagcagattaattgactgatgaaataaacttgagatgagagagcacagaggaggttcaagagatggaaccatatattcctctctatctgctcccaccatcaagggaattaatagcatattttataatgaatccctgataaatattagtctataattgaaaatctattaaaatgactatttcttagggtacacaaaaatattacaacaaaacaagtaaagaaaagttgccatgggatggaatattatattttcctgcatgtctgcttcaaggcagaatcctaatggtcatgtaggtaggtaaattattctttttacagcaacttctgggaggtggtatttggtggcgcataaaaggcaaggggtgtagtgagggtaaagtgtaagtactttgatcttgagccttgactatattggacttgggatctcggaaatcttggggataaaccgtggattaaatccataaattagtagagtgttgattatacaacaggtagaactacgtgccacttttggagggatagtcttctttttttaaaaaaacaaaaggccttaaaggctttatatatatataaagcctttttaaattataataaatacatattttttaatgaaacaatctgcacatatacaattccactctcaagaaaggcaattatttacataattttgcagaaattcctataattatgaaaataattgcctttcttcagagtggagttgtatatgtgcagattgtttcattttaagaaaaaaaatatttattgatttgattaactgaagttctggacgcttaaaaaatgattaaaatacacagatctactatctgtcttcatgaactttaaatgtcttgtaagaaactcaagtaataaagactacaacatttattatttaactggaacatgtattatttattatcctaactgtggttaggaagcaccattatctattatatctaaattaatcaagttgtatcctgtaacaggtttcctgttatccactcatgtcttctaacttctgaagtattgtttaaattacaaaggagaaacctagacactacattttctaggatctcaggacaatagagctccaggtgaaattatgctaaataagggcatgagtgtaagatgtggatgtcacagtgaagagatttagagcatttttctggtgacctcctgtttaggtttgacaagcatctaaaatcattgttagcaactttcccataattattgcattttcagcctttatgaaaatagcagcattttttttcctttctttgcccatgcacaccatctaatcatgagataagtctccttctgagtccccaaatacatgacatacatagattgggatctttttctgacctgttcctgtctgatacattcttcaactctaagatgagttcatactcatcttctgaagcccctgggaaatggaaatattttttcatattagatgttggtagagacccatcatttaatgaacatctatgtgccaggaattgtacaaggcacttagatacattattcgtgtacctcacacaaatgtatcaacaacacaacaaaatgtctgtatgaaataataattattatatcccttatatggaaacagatccagagaggaagatacactagcatgtgtaaatagaggattcaagaattaaacatccatctgtccaactgactacaagctctttcataaaatgctaatttctctcctgcttctaattttcttatcaaaaattgtcatctattgttattgggtctatgggtgggtagtgactccttggtttccattttgttctagcggattactgtctttatttttgttctagtgtttattgagagtcctaattaattaacctggctgctctgacttccatcagctcaccattgtctcttcttccagctcataatttctgtaacagagctctaggctatgctaaagttctgctatatgctgccagtctctctagatccaagtgcctcttgtcggccaagtttatatgcacgtgtttaaaatcttcttattgactctatatacaaagtcttcacatgccttcctccttaaaataatagcattgtgagaagaaaaaaaaatcatcattctttttaaaactaattcaggatgtctatgtaatacaacaacaagatgtgggggaatatttacctggtagttctgtccctcattatcattctcactcattataaaattggtatctgaaaaaaatcttgctgcaaaaacaaaaaaaatgtatagggtataaagaaaaagtttgcttcacatcataaccattacccatcccattgccaaagggaagattgtacactacatgattccggggagcagcattcacatagactacagtgtgcatggtacatgcaagagaccccatagtactacccactttgtcctccttgtagacatgctcacagatgatccatgctccctgacctggagtagtcaaataaaagagtagcatcaatttattaacattctttccagaccattttctaggtattcccattatatattccttcaaatggaaggattttattctgtacatcgcatctcactgtacacatttttttctgaaatctgaaatctgagtattttaattttatgcagtttcaactgtgagaagtacctgacagactgacctgacctaactctctctaagctaaaacactcataaactagcacagaagctttacacatttatccatttctctaatttacttatctattttttcctgaaacatctattaatctggcagttatttgagatgactgtgagcttactatttgccagtgatggcatgagcaccttggtttagtctagtgcctggcatttattttcctaaattctggcagcaagtttagctgtaagcatattttttatcagaacaatcatccatctttaactacatgtgaggaaagtactttcttatattgcattacacatttttatatggccacagaaatccttacttaatctgacaaaattatggcagatttctttctcgtaaggtcaaggaaagaatcattctgtactgtttccatggagatgtttctccttttctcaattgccaattgtctactgtgtgtcctgggttccttcttttcatatgtcatgaggattctcaccccagcattctgctcctctgagtaaaagcccttgacttttcacttctcagttgttttgtttgtagttttcttgctttcctttatttttcttactctataaatgctacgaaagtgtatgtaaaaatttacccatcttttagtttatatttgttatcaccctttattcatataccaaaccatataggaaatgaatataaggagatcttccttagtaggaggtagaagtaaaattttgtttagaataaaaacagaaaaaaagagaacaaaattccatatcaccagtttgcttctaaatgcccaataagtttccacttatgagcttgctactgtacacaacgcaagggcttgtaaaaaattgtctaaatgatagtggttaaggacgtactttaggctaggttactttaaaaaaatatatcatcacttctgccgtcaaaagtgaatttgatgtatcataattgttaaagttgaggagggtcaaggattcctctcattctatggtttccttataaatacactttctaataaatgcctaatttttttctgtgaaattaaaccattagatattgctgaatgtctgtgtgtttcttacttttctagaatctcattcttaattatagttttatatttttccttcaacaaagtcttaaaacccatgcagctggtgtctattatttacattctgtgatgtattttatttgactttgtgtttttagtcttttcacagaaatccttttattgtgatcttcttttccaaaagcacttatttcatatcttttttccatacctatcttcattagcaggttgcatttcagtttcttcagtccttttttagataatatattttactacatctgccttcacaacactgtatatgctctgatgatcaggtctccctttttttttttttttttttcaattctcgtcctctttgggacccatgacaaagtaaaaggcagacttttttctcacctgacttaaaagtaaaaaggtggccgggctcagtggctgatgcctgtgatcccagcactttgggaggctgagaagggcggatcgcgaggtcaggagatcgagaccatcctggctaacatggtgaaacccggtctctactaaaaatacaaaaaaaaaattagccgggcatggtggcaggcgcctgtagtcccagctactctggaggctgaggcaggagaatggcgtgaacccgtgaggcagagcttgcagtgagccgagatcgcgccactgtactccagcctgggcgacagagtgagactccatctcaaaaaaaaaaaaaaaaaaaaaaaagtaaaaagcctcatatgtttctcctctgattcttcttaggcccagcatttccaaaaccaaaatagtacacagaacattagttgtaatgatacttcaaaaggttcaaatactagtttttggctgctttctgtctatatttttcttctagagaaattttctgttatgaagtattgaactattcagtatactttaatattttccaaataaagtttcaaaactgatatttaacaatattctcttatattcaaacatattctgaactattttctgctgtgaacctctgcctttctggttcaagcaattctcatgtttcagcctcccaagtaactggaattacacacacacgccacctcgcctggctaatttttgtatttttagtagagacacagtttcaccatgttggccaggctggtctctcaaactcctgacctcaagagagctgcctgccttggcctcccaaagtgctgggattacaagcgtgagccactgcacctagctggttatacatattttcaagtctattgatacctagtgccaggaacttgatttcaagaagaaatatatgttgtatgaatgcaagggctgtgtttgcttttgctcacctgcttctgcagtggccaggctttttgtcacattaaaggtactcagtaaaacatttgctcaatgaataaatgtatggcacctgccactgaaaattaagaatgtctccaaaatcagacaacatgacatgcgtatctcttttgggttgccagtgttgtaattctactcacaccagtggtagttcttctgaggcactaacaagtagtatttttctggtggttatgatctcactttccagcttctctcatgtatcagagatattttatagcagttgaaaatttgaactctcaaattagataagttgtaacttagagtcctccactaggtagctgtgtaaactcgggagtcatataacttctctgggcctcagttttcctccatgaaatgggaagattgacagcatccacttcaccgagaggttgtgaggattaaatgagctcattttcatagaaatgcattatggtgctgagcacatagtaattgttcaataaatgttttctgttatttgacataattgagaaactctgaaaatactttttcctccaaaagggagtatataaggaaagatgatgattctatgtaaacgtctcaaaaaagagccgagaagtacaaatgagaaaatacaattgagaaaacagaattttaaaagatttcataaccttttaaattcctccttggttgtttttattatcccaggcctatttctttctaataattggcagaaaaatcacagaccaaaggcctcctctggcaggggagcctggaagagcagctggggagattggcgtcctaccccactgccagtcttcccagggactgagagagggaacaggaaattggtgagtgtctgaaggtctacagtgagggggacagaagagagaatgcagggacaagtaatagactgataaaagactttgagacttgaagagtttccagtttggacgagctgctggcactgtgtgcctgggtcagtcacagtgggatatggatgctgactactgagtgaggatcgagtaggtgtgtgggcaagggcaggtcatgtcccactaaggactggcagaggctggcagtgctaggagaggaccagtcctgggggagggagagctagtgttgaaaacagggaccaaatcaagcctttgttttcccagatgtgctatattcagtcatttaatcgacagctgttcttgagagtctactatacgccaggtgctgatgcaggcccaggggtaacagcagtcaaccaagaaacaggcaaacatttcaccctttgtggagctgtgttctagtgggaggagatagacaatatacaataaatataaaacataccccagtgatatgtattagaacataataggtaccttttttaaaaaagagctgaataatgagggtggtgagggtgagtggtgaaggggaagtttgcaatattgattggggttaataagggtgggccttgttcaaacagtggcatgaaagccaagacatgacgcaggtaaacgagcaagctagagagtgttctaggcaaatgtaaaagcctcaaggtagaagtctgtctgtttttgaggaaggccagagtggctggagcagagtgagtgagggagaggatggtaggaaatcagggcagggagattaataggggaccggttagtagggaccccaggaggccactgtagtgttggatattcctggatcagagtttctcaaatcattctccacaggtaatgtctattctccaagagagttttccttggcctgtggccaggctgctcaaatagaatgcagaaacaaagaatttgcctgaattctgctagccactctccaaggtcttctcctgcgatgggtggagggactttcagggcaaccctgttctaagtaggaggtgaaggtgatatccagacaaatccttcctgggtatttgctcgggggaacttgggactttttggcagtattgtctaaggctctggctcattaattcagccctcgtgttcccgtatctgcaagggcataactgcagtcccctcagttctctgggtaatgtgactctcactgcaaacctcaacatggaaagctcttgctaaggtgggaaggtctcagtcctccaaaggaaacgaagttgtggcagcctttttactagaaggatcaacttagtaattaacaaaaatacttaaaataatgaagaggaggtgggtgtaatcaagaactatgattattcaggatctctgtaggagtaaatgtattacttcaaaattctccagttttgcacgcccatgtttattgcagcactattcacaatagccaagatttggaagcaacctaagtgtccatcaacagataaatggacaaaggaaaggttgtaaatacacagtggagtactattcagccataaaaaagaatgagatcctatcatttgcaacaacatggatggaactggagatcattatgttaagtgaactaaaccagacacagaaagacaaacgtcgcatgttctcacttatctgtgggagctaaaaattaaaacaattgaactcatagagatagagagttagaaggatggttaccagaggctaggaagagtaggagaagagtcgggggtacgtgggtgtggttgatgagtacaaacaatagttagaaaggatgaataagatatagtatttgctagcacaacagagtgactatagtcaaaaataattttattgtacatttttaaataattaaaagagtatacttgggttgtttgtaacacaacaaataaatgcttgaggtgatggataccccttttaccctgatgagattattatgcattacatgcctgtatcaaaatattacatgtaccccataaatatatacatctactatgtacccacaaaaattaaaaattaaaaaattaatctccagctttggagtcaaaagctaaagccatttttttacattttaagatttgggggatgaaaaatacagcattatgcttttaacagccctttacagctttaccattttttaacctttgtctcagccttcttgtgtttaagtataagtgttctctttatggaaacccaaagcttcccttatttaaatttcaaggatgttgaaacattgtaatgtttcattacaattaatgaaacattacattaaaatgtagagtctacatcatgtacctgttttctttttttttctttttttttttttttgagacagtgtctcactctgtcgcccaggctggagtgcagtggcgccatctcggctcactgcaagctccttcctcctcctgggttcatgccattctcctgcctcagcctcctgagtagctgcaactataggcacccaccaccacgcctagctaattttttgtatttttagtagagacgaggtttcaccgtgttagccaggatggtctcgatctcctgacctcatgatgtgcccacctcggcctcccaaagtgctgggattacaggcgtgagccaccgtgcctggccctgttttcttttttaaaaaatgttttatatttttaattacccttttaactgaacctgttttcaattcatgtgaatatacataaagtataacactaaagagttaaagaaaatatcaaaaaactctcccaagaggtgtcaactgagtaataacaacctagttggaattaagccactttgacaagctacactttctgagtgcttatgtaccaattgccttaacagacatttatttcttggtgtgacaggctgctgaccttagatcgtaagcccagccctgggtttccccttccagataaaactctgttatcagaccagagctggcttgctcagacacagtgccagcctacctgaccacaccctgccaacagcagctgctgaggagtaagactgaagttacccaaatgctcgtccaatgggctcacatgttaaagaccaaatattccccccggatcatgatctcctcagtcctctcatctccggaaatggagctaccatcctttcagttgttcaaactaaaaagctaggaatcgtgctttgattcatctccccccaaccatgtacatctaataatacagctaattccaacagctccttctccaaaagatgtcatgactctgtgagctaccttccatctctaccgccataatcctggtccacacttcatcacacctgacctcagttattgtgatagctttctgttttattttattatttgaattttattattttattttatatgagacatggtctcactctgctgctctggctggagtgcagtggtgcaatcatagctcactgcagtcttgaactcctgggctcaagcaatcctcctgccttaacctcctgagtagctgggactacaggcacatgccaccacacttggcttatgtttttattttttgtagcgatgaggtctcactgtgttgcccaggctggtcttgaactcctggcctcaagcaatcctcctgccttggccttccgaagtgctgagattacaggcatgatctaccatgcacggtcccatagctttctcagtgatcgccatattcccaaacttgcactttctaatggccgtcagaatggttcttagaaacctatatcagaccatttcacgcctctgtgtgaaatctcctatatctctcactgcagtaaaataaaacccaaattccttaccttggcctacgagactgttacttgaccagactcttacatacttttctgacttgaccttcatccctaaatgccacgctccagtcactctgggccttccttttgttttctgaacccattcaatttgttccagcctttgtataaggtgtctcctttccctggaacactccctccacccccttgtcttctcaaggctggatatgttattctgatctcatcttaaattaccacttcctcaaagaggtcctctgtgactccgcagtctaaagtagcccccaccaatccgtctctatcctattttaactttcaagaggatatttttcctctttatttctttttcctagctgtctcccacccagtgggagacactttcaatagcttgttagtaatctaatatttttttctgattgtaatagtagtgcatactcattgtaaagtatttggaaaatacagacgcaatagtgctttggctgggttagagtcccagaatgtgaactttatgagagcagcaattttgacatgcagttttctgctatatccccagcacctggaacagtgcttggcaagtgaaaggtgttccataaatagtcagtgcatgaataaagttttctcttggtggggttgatttctgagttggttccatcatgggttggttatctttatcttccactctagactgtcttccttcctgtccactcatctgataatctacatgccccattcatcactagggaacccgtcacaggaagggagtgggtgaactagcataagtggaatagctaaattgagaagactccaaaacttatgccttgctgcatacaaattgttagcaatatccttttgcttattagaatattctgaattaatatatagatgttctaacacaaattcatctcttttagcgctttgctatctctaaaatagagagggaagaagcattgttctatttctcactgaaaaaagagtattacagaaatgattttagaagttttaaaagtgctattgaaatgctattttaaatacagaaatgctattttaaacatggagaattaaagtccgagccatatcatctagcaatctaacaaaaggaaacgtaactttgggctttgaaaccagactatgaacagaggctagttctctattttaagcagtgtcttccatgagtgggtatttttatattgctatctcccccagtttcaatagcttattagtaatctaatattttttttctgattgtaatagtagtgcatactcattgtaaagtatttggaaaatacagacgcaatagtgctttggctgggttagagtttaagggtgtgtgttaaagcccggtagaggaacatgtggtgtgagacaacactgccccctagaggtccttgtgtgccgcggactgaccgggccacccaacctccggagacgtcccaccgcttcgagaaggctcctggacaacgaagcgcgtccggtgatttcaaggtggggctaggagtcttgtgagaggaaactcggtcctgaccctatgtgagtgctgaaattcatagaactgtgtagacaaaggtcaattttattgcatgctaatttaaaaacatttaaaaataaaataagctttaaatgcctttaagacataatttaaaataactttagaaaaattccagtgagagactcatcccataatttagccactccttctgatgctagactgctgcactgttcctatctctgtataaataaacctgtattggaaactctgggggcataaatctttgtacatatttaagattttaaaaattaggatacagctcagaagtggaattatggagaagatgagtataaatgttttttagaactcttgatatctgctgccaagttgctttcccttcaaggtcgtgtcaattgccgctcccaccagcagtgactgagattaaatggtttgggtattattgagtacatgaaattagaagacatattcagggttggttggggaattgcctcctggttgaggtggggtggcggagaagtaggagagaaacggaggtgggtgcgtgtgtaaaccaggagagaaataggccttcacgcctgagggttatctgcttcaggtttttgtgcttccccaataactcctattttgctccttaccactttctttaggattgatttttattttcttatttcttcttcaccctctcttctggctgtagtgtaggagcaaagttaggctaccaaagcagcaatactatcctatgtaatcaaccaagcaacgtttttaaaacaccaatcatatgaaaggcactgtgcaagccacccctgccctcagaatttacagtgcaacagggaaaggtgaggttagtgtgacttccctgcccaacaccacctttctccctcctaagttgctaatggtaatgatgaaaataatgtcatcatcaggtattatttagctattggaagaaaccactcagtgtcgagttcatcaaggaatccgtcacagatgtgaaatcaagccaggcctagcaaggatgagtgcatttaattgaatgcatttcaggtagagaaatgccatgtgcagaagtgacggcctttggtaaggagtatgggactgtgactatttccccttgatgaccttgcatgaaaataaacaaacagcatttgaaaaatctcctctcctgaggtgactagaaggtgactcaacagtccatttccatgcatcagcttgctggaggaaatggaaaggcctattccccaaagcagtgtttgtctcacagaaatagagatattatgtgtcataaattgggaaaacttgtgaaatgaaacatctgttctgcatgcttaagcaccaaggcacttgcaaaatacgaatttttactccatattccaaatgctgtgatgatgagctgagaatgagtttggaaggttcatctctttccaataaaaaggttcatcatgcctctctgacttttataattattttggaacattttagataggaaattgaaagaggagggaaagaatgatgacagaactgaagaagaattgatgaaagggtcaaaaagctaaagaactttgagaaatggattttatgtgcagtcaacaatgccttcagctaatttaaccaaatcaacaaagccattaaaatgtataatgatttttattttgctacaaatctatgtagaatgaaagataccttgtgaaatgcaaaatcttccatatttgggatctaagcacctgcatagatgtttgagaaaacggaaggtggctattcttttattgaatgcttttagaacataatgctactcccccctgctcactccaccgcaataaacactttattcactctggatgccctcaatttcccctaccagctaggagctgtgtatcactctccaatgtactgttgattttcaatctagaccagtctccaaggttactcttgactttaaaatacacaacaccaatttgcaggttccaccagatatccaggtgtgaaattttctgaggccaatttaaagaacagactgtctttttttcttaccatggtgctgcatattattggtgctaatgctacacctaagggatttcaaagctcatttccaaacatcatctcatttgaacttaaccagaattgggagatggactgtgcaattatttttacccagcattccaaaaggggaaaaataagcatctgaaaatgacttccccaaggtcacacaaagaaccaagacaagacactacgtttcctaactcctattactctgttttctattgtattatatactttatgcttgaacataaccaggcaagtcattttccttgaaaactctcaggagaaatgttctctagtcccaatcccttgtctaatttctacttaaacctatatcctcccccatttctccttctcggtaggcatgggggatcccacactgcagatcccacatgcctatcaggagagtagtgaccttatagagtcccacatggcagtgtaaagcagtgagagtcacctcttgggtccacggtggactgatccaaccatgtgggcagtggtcagaggggagtttttaaccagcagtggaccagaatgggtcacatcagcaaggttggtgctgcagcaaagtggccattgggatgataaagggatagtgatgctcacgtcccagtgtggatggtgggagagcatgcatgttgctttctgtgatagtatccatcatggtacatgagggcacagtcgtttctcctaactctggaataccaggtttcctcctcgactctctcaggattctcaggtaagagaggagaggcatgtgtgagggataggaggaagccgaaaggaaaacgaatgggcagagatgacataaaaggcatatttaatgagggattgccagggcaaaagaaatagatccccctttctttgacataattttcaaataatcatttgtatcaaacagcatttcccccttggggattttgagggacaggtaaggccaccaccccagtgcctgagtttatacttatagatacctgcctaagacactggatgtgtcttggagggggactgtggtcctgcattaggtaggtcggtgctaatgagctaatgaactttggttcaaattgtagaagtaaactgaccactgttccccgaagttgatacggcctgggtgatacttctcagactttcgagtgcctaagaatcacctgaagattccgattcagtgggttttagggtggagcctaaaatcttgcatttccaacaagctcctggtgatgctatgatgctagtccgtagactagctaagtagcaaggagccagggacattcagattacactatgtatgtggttttgcaccctgattttttttttccttttaacctcttaaaactttttgcttaacattttacataaatgttttccctatgatattaattattctttagactcatcgtttttaataaatgtgctatttagttacttggatgtgtagtgatatatttgatcaactaccttttgtttgaaatctaaaatgcttcctgtttttacctgtcataaatcatgatgtcatgagcatccctatttataaatctttgttggcttctctgcaccaaaactggcaagcaggacagagcattccattagggaaaaaaagaaagagagagagagagagagagacagaaaagtatataaaagaagttgaaaatactgttttaaaacaaatattgactgatctctaatgtccacatccaaggcacttgatgacaggaattatagaatattcagaaaaatagagtttttctttcacttctgctataacgtgtacttggaaactacaccataaagtataaagctcgaaagtggctggaatttctgcatacgatgtattgtaattacagattgcgctccaagatttgttataaactttgtgaagggaaaaaaacacaagctgtgttttgtatattaaacattaaaattgtaggctatatcgtatgcaatggaaggaaaatatgccacatacattgaatttttaaaaactaccataccataattttgcataaaaactaataaacaaattgtattaagtgggaaatagttaataatttggcctctctggtttgctgctgtgtcgccaggtcctggctcccattaagatgacatctagcctataggccattgaatagaaaaaagacattccttcctcaagcacttaacttccattcagccaaagcttatgtgtattgattttgttgcaagacacggtactgccgtctgctagaaaatggtgtagcaataaaatccaaatgtaaaatttctacattgtgaatagtacttcccagatgtggtgcacagtctgcacaagcataggcactggccctacatctaaatagatttttctggaatgaaagaatgaatgtattctattgatcctggttatgctttgaagctgtaatctgtcagtaccctctgtggtcactagataggaagttggagaatattcagagtgataaagagaagggtaatgggaaagtctaaatgagtgcttctcaaattttaatgggcgtatgaatcacccaggaatcttgttaaaatgcaaattataatttggatgtggggcctgggattctgcatttctcacaagctcccagttcacttatcatctgataagaatgctgttggtccataggccacacttcgagtagaaagactctaaaacaacagtcaatcttggcttcttgctaagtaaatgttttttagtaaaaattgtcactcttagttcattgaaattgattcagtattctattaatttctgtgttgaatcttggaatggaaagaaacttccaggtgattctaatgtgcagccaaggttgagaaccactggtctagtgaaaagtcatgcatccaaagcacctaaatgtagggactacgtgtaaaaggcattcacaaatgaaaaacatcaaataattgtgattttacattttaaaaaaagaattattcttcgtctgaatatatttatcaccacatgaatgatatacattactaagtattgcaggcgtgtccaaccttttggctgcactgggccacattggaagaagaattgtcttgggccacacataaaatacactaacactaacaatagctgatgacctaaaaaaaaaaaaaaaaaaaaaaaaaaaaggtccatgcatagttttcatgatatccaccaccacagataagcaaaatagtccttgcattgaaaaggttggacacagctggaaggagtttagaggccggaagagctctataggcagaaatactttgggaatgaaagtaatgggaggacataggacaagacgctgccctcccggtatctcaggtgtggcatgagcatacgtgacaggggcagtgagcacctgggctaaggatagctattctactcctccggcattgttcttcttacagagttgagagctcctctgcactttgtgtatgccatcggccagctgatagtactttgcaactctgatcaatcaacatgcttgcagattgttacaatcttgccgttttcccatccacgataatcgcatggctgtatcttaatgccagtttactgagttgtattgctaggggctttctaattcccagtaaagatttttaaatccctcagccattttcttacttaaaaccattaaaggtagctttaggtatgttgaggaatgtgtgtggatgatacagcatttctcttctgcctggaatagttgtcttccctattgccgctgcattccctcatctactctccatctcattttaacaaaggattggtattttagaaagaactcagattctctttggggaagcgagcgccaccacttgtaaggtgatttttaaagatatattcacaagttatttgatgcttctctcccaaagagatggagctacattccccttttcttagtgtgggctggacataaggactcagatagatctggcagaaaggatgaaatgtcacttttgagattaggttattgaaagactgtggcttctgtcttgggaggtgcgtgctcactttttcactcttaaactcctcactcggagaagccagctgccatgccgtgaggcagcctgtggagaggcccacgtagtgaggaactgaggactgctggcagccgtggcagtgagtgcagaagcaaatccttccccagttgaggctgcagatgactacagccctggcaaacaccttgactgaagtcttgtaagagattctgaggcagaaccacccagctaagaagctcctggactcctgactcacagaaactgtgagatgacatttgttttttaaaaaaattggtaagcttggctgggcgcggtggctcacgcctgtaatcccagcactttgggaggccaaggcgggtggatcacgaggtcaggagatcaagaccatcctggataacatggtgaaaccccatctctactaaaaatacaaaaaattagctgggcgtggtggcgggcacctgtagtcccagctactcgggaggctgaggcaggagaatggtgtgaacctgggaggcggagcttgcagtgagccgagatcacaccactgtgctccagcctgggcgacagagcgagactccgtctcaaaaaaaaaaaaaattggtaagcttgggggtaatttgtaatatagcaatcatcaactgacagaacttgcctgaaacaaaatatttttttcagcaaagaacctgctattctaagcttgctgaaactggctctgtattgaaaactagaatggaaaggaatgtttagtgtcagggtaaattcatgaatcagtggacccaacagaaatgcagtgtgtgtgtgcgtgtgtgcgtgtgtgtgtgtgtgtgtaaaatacatctcacttctttggaagtgaaagatgaatttttggaagaacaaaactacaatcagttctttgttgtcattgaaatcatttgataatccgaagcatgcacgcacactcccaaaagagtagaagatggtagctcacaagacaaggaagactggtaaagctactgaggtctgtgggagctgccctgtaagtcagaagtgcccacaagttggagccattaggttttaaatgacagaaacccaattcaagctagtaagcaaaaagagaatttattgtcttacacatctgggaagtccggggctacaacaaacttcggtactcctgtttacggagttctctgtctccctcatcatctctggccctgcctccctgtttctttcctcaacttctcctgtgagaaatcactttctttggccaccagtagcccagcttctcatcctgagtttgcctgctccatggcaaaaagtgcctttctcctaacaacaattaatccaaccctaggaacattctgattgcctggcttgggttgtaagcctttggcaaggggaaggtggtgaagatgttgtgattgacaggtttgcctggaccacatggaaagagagggagtgattacccaaggaacccaagaggagggtgggtgagagggctgttaaacaaaaatataatcaccgaagctccctacaacctggaggcttgatgagaataagccatgacacatggttgctgtcgtatggttgctgttctaaacacatggttgctattcttatggtgcttcagtgagatgcaactagaggctcaggttataggctgagttaagccaggaatggggttttcttctagaaacttctggaactgaaaagttaaattactaggaagtcgctggagaggttagctggccctccatgtctattctacttaaagctgttcgacttataagtatgagaatttaattcttctccactcagcaagagagaagaatgaggtgtctttgcctttatatttctaagagaactcatttagagttttaaaacacagggagattaaggatgtaggaatgtgtggaggtggtagacatctgctgaatttttttcataagagagtttgagttgagattctgacatatgcagccaagagatcctaataaagctggttctaaagagatccagattttcatattagaactataataaatgagatttatgtgcttttatgaaactttacgttagcaattaaagtattttgcactggaggatcagttcaagggcaaatctatgcaaaaatgttccaactgaaacctttgtattcagaatcacagtgtgttagaactgaaagaggcctgaaagatcctatttgttttttaagtaaaaagaaacatcttttcatatgtttaatggttatttgtatttcttcttttgtgaattgccttttaaaattatttctcatttttctgttggaacattaatttgcaaattatttgtaagtgtttttatatgcataatataaacatattatttgtcatatactgtatgcatctttcctttttccatgttatagtgctgctttctatatatccatgaagttttaagttttttgtaagttgatttatctctttgtagattatatcttagtgtttataactagtcaaaagacttcccaatacccaaatacactaaatagccacatattttattttgcaatttttaaaattttattgaattttaaggatctgtctttaatttaattatatataaatctttaacaaatctgaaatttaatttgtgaagtaggcatctaattttattttttcccaaatggttagccaaatattgctgtaccatttattaagtaatctagtttttccctattcaactgaaatgccacactgacttaatgttttatttgtttatttgaggcggcagaacttctcaaaacatttattaacagagaacaatgtttcatgtaattagcatttgacttaatagctcaatttgaagaatggaaaaaataaagggaaatgatagatttcagtactacgaacaacatttgttgggacttttgaaggtagataaattggaagaaaaagtattatgttgctttattttaaaaatagaagctagcaatttttagctgcatttgaggactttattttctttttgcattttcttccctgtggtctacagatttcctagcagacttaacatctggcattggggaatccttaaacccaaggaaggaactgctggcaggaaattttctgtggatgttaggattgggaaaaggggagatgaaataagggatgtgcttccttaagattataaactctatccacaaagcccctgtctggaattctgggttgaattgtatcctccccaacccccaccgaaaaaaaagacatgctcttcaacatatcttcctaacccccagtatctcagaatgtgaccttatttggaaataggatcattgcagatataattagttaaataaaaatgaggtcatactggagtagggtaggcctctgatccaatatgactggtggccttattagaagatggccatgtgaagacagaaacacacaaggagaagaccatgcaatgatgaagacagagactggagttatgcagctgaaaaccaaggaacagcttcttatgtacttaatttgtgtcagatttcactacgtgtcaaagcttgctataaaaccaccagaagctaagaagagaggaaggattcccctacaggtttcagaggaaacacggctctgcttacaccttgatttcagaggtacagctttctagtttgtgctcctttattatggcagccctaggaaactaaagcagccctcatgagttttaatggcctcatggcttctgacaccaaaatgcccccaaaacacctttgatctgaattttgtcaaattttgaacacttataggagatgatataactagaatatgatgagatacttattaaataaagcccaatgactccatgaattccaagtaaaagttaagtaaatcccttaaaatcagagctagaataattgttctgccactcattagctctgtgatcttaagcaagttatttaacttcttggggcctctgtttcctcatctgtaaaacaaaatatctacctcaaagggttatcataaaaactggacgaagtagtgatgcatgcaaaagtacttagaacagtgcttgatacagagtgagtacataatcgatgctcttcttctttttcatctcctacccctcctcctccacaagtgcagctgaacaaattcaaaatgatagttcatcaaataattgcaacaatatgctagacactcatataaagatccattgtaatgtagtcattttgcaatggaagtttggccgtgtgacaagaatgtgcccctgatatgtctccttgcaggttactatgaactgaattgtgtcctcccctggcaaactcatacgttgaagccctaatcctcagtgtgattgtatgtgaagatagggtccttggcagataactaaggctacaggagtcataagggtggcaccctaattctataggactgtagcctcataaaaagacggagagagagagagagctctctctatggcaagcaccgaggaaaggccacatgagcgtgcagtgagaaggcagctgtctgcaaggcacagagtgcactcactagaagccaaccacgctggcaccctgatcttcctcttccctcttcagagctgtgaaaaaattaatatctattgtttaagccacccagtctatggtgttttgttatggcagccaaactgactaattcacagattcaacactcaaagggttaaatatatatacctcttggaacagacaatgtggatctccctgcttggctgatcctccttccctactagtcttccaaatttgtagtgctatagggccctcttctttacccttggtcttctatctcaatccagcccaaggctttaaataccatgtgaaatggtttgaatgtatatgtccccttcaaaattcatattgagactcaatccccaatgcagcattgtcaagaggcaaggcctttaggaggtgattaggtcgtgagggagctgcctgtataaatgaattagaaccttataaaagggatggagggaactagctaagctctttttgttcttctcctttctcccatgtaaggatgctacagtgagaagatgccaggtcctcatcagacaccaaacttgctggtgccttgatcttggacttcccagcccttagaactgagagaaataaatgtctataatttataaattacccagtctgtaatattgtgcagcacaaagtgactaagacatcgtatgtatactgatgacatacagatttagtcctcaactcttccttcaactgcaggcctatgtgtccaacttccttcttgactcctccacttggatgaataataaatagccacctcaaatattttaaagtccaaaacaaacccttcattgaactgtttgttccctcttttcaaccatgccttgtccatgtggacacccccaccccaaaagtcatccttgatttctttttctttaccccctctgcccacatccaacccatcagtaagtcttgtcagttctacttccaaattatgtttttaatgttattcccatttctcagttccactatcaccaccacgactatttcttgccatagtctcatttcttgccatagtctcctaaatggtctcccagtctctagtcttgctgtcttataaattcctctccactcagtagccagagttatctttcataaaatataattttaattttacaaaaaaaatacatgtgcagagtttaagcaggcagagttcaacaaatgataccaccaaaaggaaacaaacaaacaagacataccaataccttccagataaataatttttaatggcttcagctcagagttatcttttcatttgtttgtttttggttaggttttttgaggtacaatttgcatagagtaaaatgcagcaattcacatatttaggtatacattccagtgacttttgacaaataaattcagtcatgtaaccactatgataaaaatatagaatatttcctttacccataagatatagatggatatagatatagatataaaagatacaaggtctccttctgttgcccttgaactcctgggatcaaacctcctgcctcaccctcccaactagcagggattacaggtttgagccactgtacccgtcaccataagttatattttaatacattaactgaatcatgtcaactctttaggcaaaaagccttcagtgactttcttctaacttagaataaaattcaaactctttgtcagggtccttgaagccctacaaaactcacttccatttacttctctgaactcccctaataacaagtcccctcactcagcagggccctgctaaggagtttcaatctgcttcatggacattcaacctgcctctccccttgtctggaatgatcttcctctgatgttccatccaccttactttttctgatctctttattcagtgtagctttcaattcacctcaagtaagttattaattattttatcctgtttatttcttatcacaatttgggataattttgttaatgtatctttttgcttgtttatgtcttagaccaccagaatgtagcaagataaaggcaggaccttggtccatttatgcaacactatattcccagctcccatgatattatctattctaccacacagagggttcttcatattaggttgaactatttggaattacccacatatgaccatttttaacctacaagaatggcgatttcatatggttcatttggtttataaatacttgctgaataaatgaatgaactgaaattttgagttgatgccaccaggaagagaatagacagttatatttgtgcacagttagaaagagttcgctgtcctgagttcacttgatcactttttatcctaaattgccacccgctaccgtcgtcgtcttccacataataattttctattaggaaaattattcattaaaacagataacatgggtcacttaagtgtaaaacttaaaggtaacacttttttaaggaaatctaccagaagaaaatctttttctaatttttaaagtttaatgaaacataatttacatacaatgtaaatggctaataatttacgtacgatagctaatttttaactcttcatgtttttctgttggcaggcaacgtgttggaccttccggagcttctcagaagacagagggttttcttttgaggtaaatttgatagtacattttgatagtacaggaggcgatacggcatggtgacagaaaagcgccggcttggttagcgggaccacctggcagggctgcaggctgtgccacttaccaggcaggggaccttgggccagctgcttggcctcactcaccctgtttcctcagctgcaattgggatgaacagactgcctgcttcggggttgcctaaaactcacattgcttaatgatgtgaaatgcttagcgcagtgcctggcatagagagaattctcattagatgatacctcagctgggctttaggagctacagaagaagctgcatctccatgagctcagcgtgtttctagctttcctttttgttttctattcaacctttcacccaactcagcttctcaatccctaaatgacaaaggtttgggaaggaagacttggaccgatgcttgcatttgtttctgagaattaaacgttatgttttcttcaatccaaataggtttgcttgtacagccttgttcaatggtttttttttttttttttctccatgataaatgactctcaacttcttttccctcatttaattgcttatctacatacaatgcctggaaggaaataaatgtaatggcccgtagcagttggccttcaggtatcaagtttaagtccctttaagcagaacagcaaattgagcacagaatgaactggtttcatggtagcgtactgcaattagatgcaagaatagggaaagcagggtgcttcaattggtgacacaattagtatagcactgggggacttctctttccacttcttcaactccgcctgcattccgctggctgaagagttgatgacatccctgaaaaatcttccctctcttgtttctctgatgccacctctgtgttctccgcctcactggccacacttcctttacctcccaaacttttaactctgagtgtcccaaacttgtctcatcacctacccctgctgcccagctccccagcctgttccccttctgacacgggcactctccttctgctgtcttgggagagaaacaatgaaggcctagttggcacttttatttctattcaaggaaccagactgtgaacaagtttaccatttagtcctttggactgtgtcttgaattcatccctcttctccattctcaccagcaccatcatcatgatggctaatatttcctgagcacctttcatccaggcatgatgccaggtgcaccaacttacttaatcctcatagccaccacctgagcaagctcctgttttataaatggaccagttcttgttgctattgtacaagttattttctttctataacgtcctccttgtcctccttccacattcttaaagaaacttgcccttcctttaaagtactcagggagccctgcattgcttcttgaagccttctccagcttcatcatctcacagtggtctctcttttcactaaatgtccaatatgctgcacataagtaccccaaagttagcacagaattgttccatggctgtcatatatgttaaaaatcattaaaagttcattttttctctcattatgggaaggatacatgctcctactagtaaatttagtaggtagaaaaaaattatcactatctagactgctttccatttagtctttatgcatagctttctgtctgcctatttttaccttgtgtttgtaacttactattataaaatatgcgtctctatgtgcattgtcaacattatttacaataacatggagtggattgacacgtattctctatatttggattaaaggagatagagtatgtgaaattaaatgggagaagtatctgatacataacaggcaatacaaatattatcacatagcgtcaacttatttgtgaatattgaaagctccaaaaaagaaaaaaggttttttttaattcccgtaatcacttattgcagtattgtgtacatacaaagtgctcaatcattttggaggaataacaattttttttcctcatcatgaagtaaggtatgctcactgcaaaaaatctagaaaataaagaggaacatactaaagaaaagaatactcccatataatctctgtcttcataaataatcttttgtaacacttatacactgctggtgggaatgtaaattagttcagccattgtgaaaagtagtgtagcaattccttgaaaaacttaaaatagaattaccgttcaacccagcaatcccattattgggcatatacccagtggaatgtaaatcatcctgccataaaaacacatgcacatgtatgttcattgcagcactattcacaatagcaaagacatggaatcaacctatatgcccatcagtagtagactgaataaagaaaatatggtacatattcaccacagaatactaagcagccataaaaaagaaaaagatcatgtcctttgcagcaatatggatggagctagaggccattatcctaagcaaactaatgaagaaacagaaaaccagatactgcatgctctcacttataagtgggagatacaccatgagaacacatgaacacaaaaagcggaaaaagagacaccatggcctacttgagggtggaggctgggaggagggagagaatcaaaaaacttcctatggagtactatgcttattacctgcgtgatgaaataatcactttgaacgtggtcagtacattatcttctaatctagactcttttctatgttctatatacacacagaaatacacatgcaaagctgaacacatgtgtgaaacaaaattcagacactcaaattttccgccaacacgtgataaaatcttgcacaatagcttcctccacagaggaaaatgtctttactacatcttaaaaatggggtaaatgaatagttaggctcttcagtgtaataatcatgataaatattctcaatatgcgaaaatacaaacaaaggactttctctcccagcaaatttagacccacatgaaaatttaagcacaatcattttaaacgaatttatcctggagcttagtggttcgagttcaaggttgaggagcagtctggggacatcagctcttaatatttttcaagttttggagcaagtggtttctaggttctgagtgaagtgaaacagaatctctaggggcatgtggtaaagataatcccatactatgtactgcgtagagttaaagagaagaggcgagagcatgaagataaaccagtacaatcagtcgttcacataccactaactacaatgatactcccatttgcttcctgtgaagtagttactaataatcactgatgtcgctttttaatttcatacatcctttaactgtcttcatataggtattgaaagagtcaacataaaagccacatccattttctaattttgaacaatagttagagaaacctaatatcttctcatatttttgtcttgcttctgtctcatgagttcccaaaatagatatattatctgaatgaagagttcatgggcaaatgtcacacttttcttggtttggctaattatatttctgcttttgcttagaataagattaattttcctattctgctaataaaccacgtgatggcaaaatgccttattctgagaaaagaagcctttggtattttaaagaattgggaagctatttcagataagctatcatatgcatgaagattaatttattcatatgaaatgttcaataaccagaaaagactgttttaaataaaaccatttcacaattaagtttttttttggttatggacagtgatttcttctaagaaacaaagcgcctgtctatatgaagaataactaaaataatggttagcaaatattgattggatccagccaagtgagcagcatttttgagtttacagatgtggtaactttgaactatatttacgtgcttataatgaaaccttacagttggagtaatagctttgttcctgagtctcatgaatattttccagctcctttgtcctaaatttctgcctgacaatcatccatttcaaggaataaaaggatataataagtgataaacctatgctggaaatttttaatctaaaaagttcacatactgtttctaataaactgaaaactattagagaaagatggaggtattaaaacctgttaataaggaaatcaatggcaacatattttaaatggttttgaattttataaagattttcttttatagcactatgtcctttttcttttcttctccttgtttgatttccaacagctgagctatttacttgttgagttatttcatatctattattccatttagaccttgaaccctgtgagggcagggactaactttattcctagtgcctgtcacatgatttgaactaaataagtatatttttccagcctgcactactacgtacaataaggagtttcttatatttacttgaaaatgttttcaaccttctagggatgacctctactattattattccattattgacctttctatgcttattattgacctttcatcttattattctgatttagtaagcagattttatgtctccttgtccataccattcaaggctatctagatttcaattgtatcttcagatttttaccttccacattgatgagtcccaatgtgaaccctccaaagcaggttcctactgcactcatcagtttctttggttgagggatagtggccactatgtccttctcaggatgttggagacatgatgaaataaagacggtgatattagccccctaactgtaatcactcatgctgctcccacccatgtctacccactggaacagggagtggtggcattggggtggtacagggcttgccgaggatgttggcttatagctgtatctccaaacatccagagcatgtcttctttttcacctctcctttagaatctgcttcctcgaaccatccctttaagtgcaggaagaaagctatttttaatgtgaaaattactgttccagttatctcatggtggaaattcttaatgggctcttactttgggcatctgtctggctctcagtgccagtaactttcttttcttcttatctttgttttgttttgttttgttttaaagatggggtctccgtcacccaggctggagtgcagtgatatgatcatagctcactgcagccttgaactcctgggctcaagcaatcctcccaccccagcctcccaagtaactgagactacaggcacccaccaccgtggttggctatcagtgctaataactttctgaagctccatgcctttaactccagcgttctttacttagtgttttgaaatatctgctgcccacaaatcctagcacatttctgaagttaccaagactttaagacctcccatactgctttttctcccatcttcccttctcagtgttattagcctcatagtttcaagggcccagcccagtatccaccacacaccatatcccatacgtacaaatacagcatagatagtattgaacatttcatttttcactttagcttggtgaaaattaatatgtatttaggtattttatagttatgactcttagttttgggttgtctatctgctccatccttatttctacctttaaatgcagagctatttccaccagcttgagataaaagaagacaatagatcctaagtcttccacttggttccctatgggttttgtttgtttgtttgtttgtttgtttttggtagagatgaggtcttactctgttgcccaggctggagtgcagtggtgcaatcatagctcactgcagcctcaaactcctgggttcaagcaatcctcctgcctcaggctctggagtcactgggattacaggcgtgagcgactgtacctggcttcgatttcctgattaaattattctctctgcagccagtttctttattccagcctgagtcattttcttgccctgggtgacatttttccgtcttggacatctgtcgtattgaaagcaagtcacttcatttatgtctgtcctcgacttctgtttgatacacttcccatgtctccaagtcacggtatttctgaaacaattcatattgcttttcattactaaactttttttccaaagtactcctctgcagccttcattcctgatatctttaaatttatctagaaggtcttatatgctagatctacatctcctttagacacttatcattaacccaatttagggtaacagaaattgttttttacattgagcactctcacaggtacctacaactgctcacagtggtcctagaaaggacataaagtaaattgaaatggacatcgtttggcaggtgatttttgtatccttcctgacgatgctggttcaactttaacatacaggtctaatgtttttttaatccctaacccaattaataatagaaaagtaatacatattcattctagagtatttggaaaatatagctaatcccaacaaccaatcagagataactacttatctttttcctttcagtctctttttatatacacatacacttaaacctatctccttatcaaattgtgatgagttatacacatagggaattgaaataaccaaatatttctataattcttataagtaaaaatagtaataaaaatgacattcaatttttacttgttgattccggtgtgcgttttcctcttttaaaatagttgtttagttttccaaattggccagcaaaaacttacttaatttataaagttactgaaatactctctctttaaaaatgaaaaaatatgatataataattttaatgataaaatgaaaaaggtaataaaatagaaaaaatatttatcttgaatgttggaaattgagacaaagcatattcaatgttcaattgaatgactatcaagtggtatctggaaaattttatagaaacctagtatttttatagatgtttttgaaaagaaatactggttattgggtttacttcactcaagaaatccttttgcttaataggggtatatcattaatactagttaagtgttggttattgtattgtataagtgttggttattgtatcttcacagtgctataaagaactacttgagaatgggtaatttataaagaaaaagaggtttaattgactcacagttctgcagggctggggaaacttacaatcatggcagaaggtgaaggagaagcaagacacatcttacatggtggcaagagagagtaaaagagcaaggggggaattgccacaccttaaaactatcagatcttttgagaacttactcactatcatgagaacagcaagagagaaatccaccgccatgatccagtcacctccccccatgcctttcctctaacatgtggggattacaatttgaaatgagatttgggtggggacacagagccaaaccatatcagttgtgtagattgaatattgaaatattgaaatcttgagtcatataatgaatactgaaatatatgtaattctcaaattatgaacacttagctggcaaaggttcttatatgtgaatggctcattaagctttggatttcctttccactgtgttgctgccctggatgacaacactgctgtccatacagacagcaccacctattggccagcacccagggcccactctgagtgatttccttaccacctttcctttttctcaaggtcctcatggccctgcagtgcttgagtacttgtctttgactgctgggaatcagtttgtttggctgaagactgtcacacttatccacacattctttaaaatccctttcttcttcttacacttctcttccaaagcttgcctggttaccttagttgaatctcactctctctctctctctctctcttctgtccttccgtccctcttcccttcctttttcttccttcctccctcccttcctcccttccttccttccttccatccttcctttctttgagacagggtcttgctctgttgcccaggctgaagtgcagtggcacaatctcagctcactgcagcctttacttcctaggctcaagcaatcctcccaccccagcctcccaagtagctgggactacagacgcgagctgccacacctggctaatttttgtatttgttgtagagacggggtttcaccatcttgtccaggctggtcttgaactcctaggctcaagtgatctgcccacctcagcctcccaaagtgttggattacaggcatgagccactgtgctcagcctcttttactttttttttcttttctttattaccaagcttctgctttgcttcttccattcttctttcctgttttctaagggattactgaagtgttttatttttttctctttttcttttttctcctcatactggtttggaaattatatattttctttgcattctttcagtagttgccattgaaatatttttagttgaatatttcattacattcccattccatctttgtttttatatttagattttatttcaccaaaaattttaaaaactcatagttgaaaatatcagatacttcctcatgagccttatatccctccttccttcccctgaaacaatcatttacatttcttttactggtcatgttggtatctacttccatgtctctaaaaaacattcatttctcaatttcttatatttctcaattttccagtttttggtattatctactgacttcccactctagaaaatgactgctcccaccatatatgtgccttctttcctcttcacgccctcacaatacagtcatattatgtttgcgtttgatatcaagcaatatatttacattaatataactatgcacaaactgttcacagctgagccatgtaggaaactatgataaatttttctttcctgagcagctttttgcttgccctggagctaattatcttgttttaccatttgcttagttttctatgtacttatcactaatttaatcccaaattatttgccagttctctaaatcttctcttaagctactaagatgcattgctttcatcttcctgacaaaatatgcttcattcttctgatggcctattggtctttatgcctgatgcgtaagacataaagctgtcatcttgggactttccctcagcatcattctggcctcactgtcttactctcctacatgtgtctcccaacctgggtgtatgtcctgggtgtgttgccctgatcttccactttattggtttaatttcttgttttggtgaagatggtaagttctggacagcttagttagggaaccctgatgttactgcatttaggttttcctcctggactgatcaggtaagattcttccaatctcctgtcagaagagtcaaagtctgctactactattttggatctgggtcaagcgagatagtggagtagagagaggtgggcattcagtatgcatgcattttcttaagctggctttgttcagtacagtgctcccaacttcaaccctgcttgggatccccaagcaggaaacctgttctctctctcctgtgaatatgcttcctgggaaagagaagggaaatagaagcggtagtgtaccttttcatgattggaaaggatctagtgatctgactgcttcttaaataaactttcaacgcatcattctcattttagtctctcctcttcaccacacttccagaagaatctgatgctgccaattcctgacacttgaaggctcttgagtgtaaaacaagttgcttcttggctttcctgctgctggtttagtactttaatttgggagttctgctaagtcttttctcactcatccaattttccaaaattgtgttattattgtttattttcccatggcccaggacttaaaaaaattcactgacaaattaactggatttggggaggaccaaatttgatgcatgtgtttaatttactccctacatctgggagctccattaaatttttacaagtataacttgacataataaaatctaaatttaattaatgtatttacccttcacctcaaaaatacaagggctttagaaactttcaatactaattaccccatattccttattaatgtttattgtttaaattctgccttttaaataccctccatctccaaattagccattgttccccattattgttgtgtataagagtgcttattcagatatagccagatgtttatacatttcttggtccaccatttcttcttgcatgtgactccttctttctgggttcagtgtccttaccattgaagtacatctttactgaagatgctgttggtgtcctgtccagaatctcttcaatgagctggcgtactcatcccttagctgctgagagtgttggctgctaatagttcacactctttccctgaggattccattcaagccaacaatttcagaaaatgcctggaaggtaacagccttcccccgtgggtagctcacagccaatgactgattgatacgggtgtacagaactgaggctccagaactccctgtgggatcagactgaggctagacttcagctaaacccatatctttcccagcttcttttcctgtcctattctgcttccttcctcgctgttcagatttcttctgagagcactccctcaggcaatcacttggacaggaatctaattctcagggtcagctgcaagagcccaatctaagacagttgatagcagtagtagttatatacacctgagtctaaggatgggattctggagtttgctcactcaccagtggtcccatcagaatctcttccctgaagatagtctcagatgtgctcctgcagtgaaattgctaacacttttacttgtagtgaaccaggacagcatataagtagaagcgaatgcattaacttctgtgatgtatctagtatttgagagtacaggtggaaaagtaacttgaaagattgttgaattgggagggtattgctaagcaccattgatgcactaagtatagatgccaggatcaaatctattaaccaccaatttaaacccaagtgtgagagtcaaagggcctccatggaagcctttaaaaagtccctcatcactggcagccagaaggccaactgaactgaagcccaggtgcagcctgtacttatgagtggcagaacgccagagaaggttaattctcagcctgtgtaagtctccctcaagagaatcagggtcctgattggaaaaaagtgggaacatgagaattggaatggggaaacttattagacacacttaaggaccttggcctcccagcttctccggaatatctgggcctacagaggtggcccactcccttgctggaagatggaagaccttctccttgcttgaaaactataagcttcgagtaagtcaagtgtcttacaaaacaatgttggtcctgctcagaatctacccccacttctctccccgataccagacagtatgaggactaagtttcagtataatccaactgggtaagtacagtgtctgttaagggaggggaggatcatatggcaaaggcactgcaggatctggctgacttaagccagcaggaccccagagaaaatgcctggaagtggatcccaaagatgctggatcaagaatggggaataggaagtcaggaaagggacactttgttgttatagtaatactgtgcagtgacataggatttgacaccctggcagtgaccctggaatgactgttagaagcttggctttcctagtatttctgtgacattaatcacattttaatcacaacttccatatctgtaaaatggaggactgggacaatattgattatttttaaaaaactgttattttaggtttgggggtacatgtgaaggtttgttacataggtaaactcatgtcatgggggtttgttgtacagattacttcatcacccaggtattaagcccagtacccaatagctatcttttcttctcctttccctcctcccaccctccaccctcaagtagaccccagtgtctgttgtctccttcttcacatttgtaagttctcatcatttagcttccacttataagtgagaacatgtggtatttggttttctgtttctgtgttagtttgctaacgataatagcctccagcaccatccgtgttcccacgaaatacatgaactcattcttttttgtggctgcacggtattccatggtataaatgtacccaattttctttatccaatttgttgttgatgggcatttaggttgattctatgtctttgctactgtgaatagtgctgttgaatatcaagcagctatggaatgcctccagaaagcacataggagtttgttatctgaaattcagacactgcatgcacaaatgaatggtaggaaaatgactccgaaaagtgaacaaaagaatgagaaaccaagccaagatgaacatttgcatgcacgtgtctttatggtagaatgatttatattcttcagggtatatacccagtaatgggattgctgggtcaaatggtagttctgcttttagctctttgaggaatcaccacactgctttccacaatggttgaactaatttgcactcctaccaacagcatataaatgttctcatttctctgtaacctcaccaccagcatctggttttcttttttttttttttttttttgactgtttagtaatagccattctgactggtgtgagacggtatcttcatagtggttttggtttgcatttctctaatgatcagtaatattgagcttttgttcatgtgcttcttggccacatgtatgccttcttttgaaaagtgtctgtttatgttctttgcccactttctaaggggtcctttgcccactttctatggggttgtttttctcttgtaatattgtttaagtttcttatagatgctggatattagacctttgtcagatgcacagtttgaaaattgtctcccattctgtaggttgtctctttactctgttgataatttcttttgctatgcagaagctcttaagagtaattagatccctcttgtcaatttttgcttttcttgcaattgcttttggtgtctttgtcatgaaatctttgtctgtttctgtgtccaagatggtattgcctaggttgtcttccagagtttttatagttttgggttttacatttaagtctttagtccatcttgagtttatttttgtaaatggtataaagaaggggtccagcttcaatctttcgcatgtggctgcttagtcaccccagcaccatttattgaacagggagtcttttccccattgcttgtttttgccagctttgttgaagatcagattattgtaggtgtgtggccttatttctgggctctctattctgttctattggtctatgtgcctggttttgtaccattaccatgctgttttggttactgtagccctgtagtatagtttgaagtcaggtaacatgatgcctccagctttgttatttttgcttaggattgccttgactatttgagctctttttggttctatataaattttaaaatagatttttctagttccatgaaaaaggttgttggcactttagtaggaatagcattgaatctgtaagttctttgggcagtatggcaattttaataatactgatttttcctatccatgagcatggaatgtttttccatttgtttgtgtcttctctgatatttttgagcagtgctttgtaattctcattgtagaggtctttcacctccctagttagctatattcctagatatttgattctttctgtcaatgggattgcctttctgatttaactcttgtcttggctgttgttggtgtataggaatactagtgttttttgtacgttgattttgtatgttgaaactttgctgaagttgtttatcagctgaaggaaattttgggccaagactataaggttttttagatataggccaagtgttgtggctcatgcctgtaatcccagcactttgggaggttgaggtgggtggatcacctgaggtcaggaattcaagactagcctgaccaacatggagaaaccctgtctctattgaaaaatgcaaaattagccaggtgtggtggtgtatatcactaatcccagctgctctgggaggctgaggcaggagaatcacttgaacccaggaggcggaggttgtggtgagccgagatcatgccactgcactccaacatgggcaacaagagtgagactctgtctcaaaaaaaaaaaaaaaaagaggttttctagatatagaataatgtcatctgcaaagagagatagtttgacttcctttcttcctatttggatgccctttatttctatttcttgcctgactgttctgtctagaacttccaatactatgttgaataggagtggtgagagaaggcatccttgtcttgtgccagttttcaaggggaatgcttccagcttttcccattcagtatgatgttgactgtgggtttgtcaaacatggctcttattattttgaggtatgttccttcaatacctagtttattgagagtttttaacatgaaggggtgttgaattttatctaaagcgttttcggcatctattgagataattatgtggtttctgtctttagttctgtttatgtgatgaatcacatttattgatttgcgtatgttgaaccaaccttgcatcccaggaatgaagtctatttgatcatggtggattagctttttgatgtgctgctggattcagtttgaaattattttgctgaggatttttgcattgatgttcatcaaggatattggcctgatgttttcttttttgttgtgtctctgccaagtttttgtatcagaatgatggtggcttcgtagaatgagctggggaggagtccttcctccccagttttttggaatagtttttatagaaatggtaccagctcttctttgtacatatagtaaaattcagctgtgaatccatgaggtcctgagctttattttggttggtaggctatttattactgacttacttttggagatcattattggtctattcaggggatcagtttcttcctggttcagtcttgggagggtgtatgtgtccaggaatttatccatctcttctaggttttctagtttgagtgcatagtggtttctagtggttatttttatttctgtggggtcagtggtaacattcccttcgtcatttccagttgtgtttatttggatcttctctcttttcttctttattagtctagctagtagcctatctatcttattaattttttaaaagaaccaactcctggatttgttgatcttttgaatggtttctcgtgtctcagattccttcatttcagctctgattttggttatttcttgttttctgctagctttgtggttgatttgttcttgcctctctaattccttcatctgttacgttaagttgttaatttgagatctttctaactttttgatgtgggcatttcatgcgatgaatttcccttttaacactgccttagctatgtcctagagattctggtatgttatatttttgttctcattagattcaaagaacttcttgatttctgccttaacttcattatttacccaaaagccattctggagcatgtttagttttcatgtcattgcctgattttgaatgattttcttggtctttgacttctatttttattgcgctgcggtcagagagtgtgtttcgtattatttcagttattttacatttgctgaggattgttttacgtccaattaagtagttgcctttcgagtagatgccatgtggcgatgggaagaatgtatattctgctgtttttgagtagagagctctgaagaggtctatcagatccatttggtccaatgttgagttcaggtcctgagtatctttgttaattttctgcctcaattatgtgtctaatattgtcagtggagtgttgaagtctcccactattaatgtgtgggagtctatgcctgtttgtaggtctctaagaacttgcttcatgaatctgggtgcccctgtgttcggtgcatatacatttaggatagttggatcttgttgttgaatcgtaccctttaccattatgtaatgcccttctttgtcttttttgatctttgttgttttgaagtttgttttgtctgaaattaagattgcaacctcagcttttttctgttttccatttgcttggtagattttcctccatgcctttattttgagccttttggtgtcattatgtgtgagatgggtctcttaaagacagcataccattgggacttgcttttttatccatcttgtcattctgtgccttttaagttgagcatttagcccatttacattcaaagttaccattgttgggtgtggatttgatcctgtcattgtgttgttagctgattattatgttggtttgtttgtgtggttgctttacagtgacactattctgtgtgtttaagtgtgtttttgtattagctcgtagtgatcttttctttctatatttagtgcttcttttgagatctcttgtaaggcaggtctggtagtaaagaattccttcaacatttgcttatctgaaaagaatcttatttttcctttgcttgggaagcttagtttggctgcatataaaattattggttgaagattgttttctgtaagaatgttgaatataggcccccaatctcttttggcttatagggtttcagctgagaggtccactgttagcctgatgggatttcctttgcaggtaacctgccttttctttctggctgcctttaacattctttctttcatttttaccttggaaaatctgacaattatgtgtcttggggatgatcttcctgtgtagaatcttgcaggagttgtctgtatttcctgtatttgactgttgtcctctctagcaaggttgtggaagttttcatggacaatatattgaaatatgttttccaaactgtttgctttctcccccttcctttcagggatgccagtgatttgtagatttggcttctttacataatcccctacttcttggaggttttgttcattcctttttattcttttttctttatttttgtctgactgtcttatttcagaaagccagttttcgagttctgagattctttcctcagcttggtttattctactgttaatacttgtgattgcattgtgaaattcttgtactgtgttattcagctatgtcggacccattaggttctttattatactggctattttgtctttcagctcctgtatcactttattgtgatttgtagtttctttggattgggttttgctgtcctcctgaatctcaatgatcttcattcctatacatatcctaaattctgtttctgtcatttcagccagctcagcctggataagcactcttgttagagaatttgtatggccatttggagcacatatgacactctggccattttaatttttggagttcttgcgttagttctttctcatctccatgtgtgggtgttcctttaactgccatatagattgagtacagtcaatagacttctggctgttttcactaggctgaggccttgtgcagggtctttttttgaagctgacttcttgtctctagtttcagaggtgagtatgttagtgaggtattcttggtgttgaagctttggggtgtgatccagtaggtggcacttaggcttattggtcaactggtagactcttgctcagttgtgtggctcctctatgttttctcatagttacagctgtgttcactctcgatgctctgaaagtgtgggttcctctcccccttgagtgccagctgtatggctgtagattgtggtttgacactcctggctgcccactgcagctctggggcaatgtcagtgtttacgttccttcctcaacttggcggcaacagaggaaaggaccttagtagtggttgtggtcaggggtcttttgcttgtatcctgggagctccacaccagagagatgtaggtcagcaattcctcagtgcaatcaccccaggatgaagggtctgtgctgtgggctcaagccaggggttctctctggtgatgagtgggggttgggggtgtgggaaccatgggagacggactggcctcctcttcttgggttgattgcagcttgttggaggtataaataaggtacttagggtcttctcttcttcattagtctgagggtagcaagggcagttctactgcagagacagtggcagagaggctttcaggaacagtatttattaaccaattgtttcaacaaatatttactgacaattcaacatgtaccagacactgtgttaggcaaggggtcttcaatgggccacaagtagatgtggtccttgaccatgtcattggagcttaatgggagagactgatagtaagcaagtaaacaagaacaaaaaaataaggtaattcaggttgtgacaacctctctgaaggaaatatataggatgctataatagtgactagagcaaggaacggcctaattgagctaagataatcaggtagggtgtctgtaaggagttgacattaagctaacaactaaagaataagaagccagccatgtaaatagcttggataagagctttccaggctgaagggaatggaaatacacaggcctagaggtaagaaggagatgggtgtcttccggaaactgataaaaagtcagagtggctcagctatgctgatatgtcccctggtattttttaagatttttggccgggtacagtggctcatgcctgtaatcccagcactttgggaggccgaggtgggcagatcacgaggtcaggagttcaagaccagcctgactaacataatgaaaccccatgtctactaaaaatacaaaaattagctgggtgtggtggcacgtgcctgtaatctcagctactcagaaggctgaggcaggagaatctcttgaacttgggaggcggaggttacagtgagttgcgatcgcaccactgcactccagcctgggtgacagcaagactccatctcaaaaaaaaaaaattaatttttgagggtatattataggtgtatatatttatggggtacatgtaatatgttgatacaggtattcaatatgtaataatcacattacggagaatggagtattcatcacctcaagcatttattctttgtgtcacaaagagtcccattatactcttagttattttagaaagtacaattaaattattattgactatagtcaccctgttgtgctatgaaatactcggctgtattcattctttccaactattttttttgtacccattaaccatcctcacctccctacccaccccacccctattacactacccagcctctggtagccatccttctactctctattttcatgttttcaattgttttgatttctagatccaaaaataagtgagaacatgtgatgtttgtctttctgtgcctggcttatttcatttaacataatgacctccggttccatccatgttattgcaaatgacaagatctcattcttttttatggctgaatagtaatccattgcagataagtgccacattttctttatccattcctctgtgaatggacactcaggttgcttccaaattttggctgttgtgaatagtgctgcaacaaacatgggagtgcaaatatattttctatatactgatttcctttcttttgagtatatacccagtagattgttgggtcatatggtaactctatttttacttttatgagaaacctccaaactcttctccatagtggttgtactaatttacattctcatcaacaacatatgagggtttccttttctctacctcctctccagcatttgttactgccctggtgttattttgcttcttaagtattagaactatacttagtgttatatgttctgtgattagaagtaaaactgcctttgctatatagtatgcatagaatattttaaagttattactagaagctgacacattgttgttttctattacaaacaataaaattagtttccatttattgagggcctgtttcatgttaactgctttacagatattccttatctcatttaattctcccaacaatcctacaagaaagctaatattatcccattttatagatgaggaaattgaggcttacagagggcaagtaacttgcccaaagtcactcagtaccagcaaatggactttttcccctctccctgcccccaaataccagccccccactgcaaaaaaacaaaaacaaaaacaaaacaaaactacttctgtagagctagtcgtctatttccaaatgcaaggcttaaattttaagccttggagttttcaatttaaagcctttgccatgaaatacagcatattactttataatagaaaacaaatagaaagagcctttcatgatagatacagtgaacactaaattctttcttttaggctgcatctaacaattctctccttaacccaatagatattatttccacaaattagcccagttttgatttggatggcaagactcaaagacaacaacaacaataaaatcacaacttgatttaaaagttaaattcaataaactgtagaagcagcatattagtctgttcttacactgctaatgaagacatacccgagactaggtaatgtataaaggaaagaggtttaattgactcacagtttcacatggctggggaggcctcacaatcatggtggaaggctaaaggcacgtcttacatggtggcaggcaagaggtcctgtgtaggggaactcccctttataaaaccatcagaacttgtaagacttattcactatcataagaacagcatggaaagaagacaccctcataattcaattacctccaccaggtcccacaattgatcccacgtggggattattataattcaaggtgagacttgggtgggcatacagagccaaaccatatcatctgaagggggccagcccctccacagctgtgggtatttctcgtcaggtgggatggggagactgagaaaataaataaaacacagagacaaagtatagcaaaagaacagtgggccaaggagaccagcgctccacatacagaggacctgcatcggcaccagtctctgagttcccttagtatttattgattactattttgattatctcagcaaggagaatgtggcaggagaacggggtgatagtggggagaaggtcagcaggaaaacatgtgagcaaaggaaactgtgtcacaaataagttcaagggaaggtactatgcctggatgtgcatgtaggccagatttatgcttctctccacccaaacatctcggtgtagtaaagagtaacagagcagcattgccgccagcatatttcatctccagccacagggcagttttctcctatctcagaatagaatgaatgtatgattgggttttacactgagacattccattcccaggggcatgcaggagacagaggccttcctcttatctcaaccacaagaggccttcttcttttactaatcttcctcagcacagaccctttatgggtgtcaggctgggggacagtcaggtctttcccttcccacgaggccgtatctcaggctgcctcagttgggggaaaccttggacaatacccaggctttcttgggcagaggcccctgaggctttccgcagtgcattgtgcccctggttaatcgagaatggagaatgtcaatgacttttaccagcatactgcctgtaaacatattgttaacaaggcacattctgcacagccctagatcccttaaaccttgattccatacaacacatgtttctgtgagcacaggcttggggctaaagttacagattaacagcatctcaaggcaaaacaattgttcagggtacagatcaaaatgagtttcttatgtcttccttttctacatagacacaggaacagtctgatctctctttcttttccctacaatcattccacccctggcccctctcaaatctcatgtcctcacatttcaaaaacacaatcatgcgctttcaacaatcctcaaaaaactgaactcatttcagcatcaacccaaaagtccaagcccaaaatttcatctgaaacaaggcaagtcccttccacttatgagtctgtaaaatcaaaagcaaattagttacatcctagatataatgggggtataggcattgcataaatatacccattccacatgggagaaattggccaaaacaaagaggttacagggcctatgcaagtccaaaatccagcggggcagccaaatcttaacactctgaaatgatcttctttgactccatgtctcacatcctgatgcaagaactgggcgcccatagccttgggcagctccacccctttggctttgcaggctacagcccctctcctggctgctttcatgggctggcactgagtgtcttttctaggtgtacagcgcaagctgttagtgtatctaccattctggggtctggagaacagtgcccctcttctcacagctccactaggcagcaccccattggggactcagtgtgcaggctccaactccacattccccttctgcactgccatagcagaggttctccatgaaggccctgcccctacagcaaacttcttcttggacattcaggcatttccatacatccaatgaaattgagacagaggtttccaaaccttggttcttgacttctgtgcacccacaggctcaacaccatgtggaagctgccaagctgcaccctctgaaaccacaacccgagctctaccttggccccttttagccatggctggagcggctaggatgtaggacaccaagtccctaggttcctcacagcaatggggccctggacctggcccaggaaaccattttttcctcctaggtctccagtcctgtgatgggagaggcttccaggaaggtctctgacatgccctagagacttttccccattgtcttgggtattaacatttggctccttgttacatgcacatttctgcagctggcttgaatttctcctcagaaaatgagtttttcttttctatcacatcatcaagctgcaaattttccaaacttttatgccctgctttccttttaaacataacttacaattccaagccatatctttgtgaataaataaaactgaatgcttttaacagcacccaggtcacctcttgaatgctttgctgcttagaactttcttccaccggatgccctaaatcatctctctcaagttcaaagttccacaaatctctagggcaggggcaaaatgccaccagtctccttgctaaagcataacaagagtcacctttgcttcaattcctaacaaacccctcatctccatctgagaccacctcagcctgtactttattgtccatatcacttcagcattttggtcaaagccatcaacaagcctctagcaagttccaaactttcccatacttttctgtcttcttctgagtcctcgaagctgttccaacctctgcctgttacccagttccaaagtagcttccacattttctgatgtctttacagcagcactccactacccagtaccaatttactgtattaatctgttcccatgttgctaatgaagacatacccgagagtgggtaatgtgtaaagaaaagaggtttaattgattcacagttccacatggctggggaggcctcgcagtcatggtgtaaggcaaaaaccacatcttacatggcagcaggcaagagggcatgtgtaggagaactcccctttttaaaaccatcagatctcatgagacttactcactatcatgagaacagcatgggaagaaaccccctccccatgattcaattacctcccacggggttcctccaagaacacaaggggattattacaattcaaggtgagagacttgggtggggacacagagccgaaccagctcaggaggaactacacaacaataaaaacaacagaaaacgtaacatgtaaccaatagcaactgaaatgtttacgtttttggtgattatatcaacatcaaagaaatgcaaatcaaaaccacaataagatgccatctcacaccaatcagaatggctattattacaaagtcaaaaaataacagatgttggcaaggctgcagagaaaagggaatacttatatactgtttgtaggaatgtaaactagttcagccactgtggaaagcaatttggagatttctcaaagaatttaaaatagaactaccatttgacccagcaatctcatgactgggtatatacccaaaggacaataaataattttacacaaaagagacatgcacttgtatgctaatcacagcactattcacaatagcaaaaacgtggaatcaacctaggtgtccatcaatggtggattggataaagaaaatgtggtacatatacgccatggaatactatgtagccataaaaaagaatgacattatgtcctttgtggcaacatggatgcaactggaggccattatcctaagtgaattaacacagaaatggaaaatcaaatactgcatgttctcacttataagtgggagctaaacattgggtacacatggacataaagatgggaaaaatagatcctggcaaatactagagggaggagagaagaagggggcaagggttgaaaaaccaactattgtgtatttttctcactacctgggtaacggactcaacttcatgaaacatacccatgtaataaacctgcacatgtacccactgattctaaaataaaagttgaaactatacatattttttaaagaagctacctcagtactctttgtgaaaggtgacaaggcagtggaaatggaatggtaaggcgatcaggaattcaaaagacatttttaaagtgtaatcctcttgaaacagaatgaagaagaagacaagaggattggatacacatacaggttgcaaagagggtctgtagcacctctctcttttgaaatgtataattacactactgtatacctagggaatgtttcagagaagaaagatggggaatacaataaattgactaattacttgagattttctctagttttatctggtttaaaaacagtattataaatatatcctaattcagaggaagtaatcaatgacgaattatcctatattctatctcttctgtatgagaccattccaatatttctactctggaggacgctaataggctcaccctggaatgcccaacttcctctatactgacttacaactttgttcaaatcccaagatacatctatgtaaataatgcaatcaactcttcacatatgcagaatgagcttggcctttagcaagatgtaacaacttaacattataggatgctcctataactccgtcattcattcttcctaaatcaatgtcttccatcctctgagtcctttctctttaattctatttttgttatttttctttgccttaggtttcactcacttttatggtaaacactttaggtaatatttttcatgaaggatggattatgaaaataaatgatacattgtaagccattgacatgttataccattgggataaatgatggtaggtaattttagagtttcaatttgataaaaggggcttcgccaaatgataaggcttagcattaaggtatttcaaattgttatatattcagatttaattttatgaaagttaagatcatgtaatatgcctcaaccacataaattgataaattaccttcatctccagtcaaccatttacaccattttccaagagatgagttttaatgtaatgtgaggcagctttattctctgagtcatctgtagtacttcttgttactacagccaaagacctcatcagcattttcattttcattataaattccaaaccatcaataaaaattaaaaactcaacaccagtttatgaaacaagggggagaagagaaaaatatgtatattttcttgcatattttgggatcgtgtataagagaaaatgattttttctgcaaagacaagattgaattgggcattctgaatacatgttgttgagataagccaaatatttggtcctagaagctgagaggatatgatactgaatgattatttagcactaaaggtttatcttcaaagaggtcttgaaataagaatatgtaattaggctgggcacagtggctcacaactgtagtcctagcacttttggaggccaaggcaggtggatcacttgagctcaggagttgaagaccagactgggcaatatggcaaaaccttgtatttttgtagaaaaagtataaaaattagccaggtgtggtggtgtgtgcctgtagtcccagctactcagaaagctgaggtggaaaaattacctgagcctagtggggtcaaggctgcagtgagctgtgatcaggccaccgcactccagcctgggtaacagaaagagtaagacaaagaaaaggaaaaggaaaaggaaaggaaggaagaagaatatacaattagtttctacttgagtcttaccggaatgcattttactgaatttcacttatgcaaacatatactggcttacaaaaatgtatgcaacatctttatgaggcagatactgtgttgtgaaacacaagaggcaaacaatgtagaagattcctctttctgttaagtttatagtccagaggagaagaaatacattacatatacaacctctaattcattcatttattcttttcttttctagttgttgagacagagacttgctctgttacccaggctggagtacagtggtgcaatcatggctcactgcagcctccacctcctgggctcaaacagtcctcccacttcagcctcctgagtagctgggaccacagtcatgcaccaccacacatggccaattattttattttttgtagagatgggatctcactatgttgtccaggctggtcttgaactcctgagttgaagcgatcctcctgccttggcctcccaaagtgtcgattacaagtgtgagccactgcacccgcccctcattcacttatttattgacaaatgtttactgaggtattatcatatgtcaggcatttttctaggcattgggaatatagcagtgtatgaacctgatactcactgctttgatggagcgtaacttctgattgtggtaagtactgcagaagaaaatgcaggctgctacaggaaccccttcaacataaagaactgtatgaaaatattgtacaaaaatatgattcaaaaatcctaaatgaaattcacattatcatttacgtgtaagggcagaagaaaatttttgaatatgcatgcatttataaatatatccccatgtactcttttgcagaaaactaaaagaacatagaactagaatttacacatcaaaatagaaaaagatgacctgaagataaaagagatgataggatttttttttttttttttttttttgaggcagagtctcgctctgtcacccaggcttgagtgcaatggtgggatcttggcttatggctcactgcaacctctgcctcccgggttcaagcaattctcccgcctcagcctcccaagtagctgggattacaggcatctgccaccatgcctggctaattttttgtatttttagtagagacggggtttcaccatgttgaccaggctggtcttgaactcctgacctcaggtgatccacccgctttggcctcccaaaatgctgggattacaggtgtgagcctccacacgcagccaatggtaggaatcttatagaggatatgttgagaacaaaagcaacctgaagccacacagcttaaaaagattaggaactgtttggttgggcatggtggctcatacctgtaatcctagcactttgggaggccaaggcaggaagattacttgagaccaggagttcaaaaccagtcttgccaacataacaagaatctgtctctatataagaagattaaaaattagctgggcatggtggcatgtgcttgtagccctagctacttgggaggctgcggtggaaggatcacttgggcccaggcattccagcttatgatttcagtgagttatgatcacaacactgaattccaacctaatggatggagagagactatgtctctaaaaataaaaaataaaaagattaggaactgtctgcactaagatgactttactattccaagaaatccttgcctaagaaagtaaagttgcaaattacttttttgtcttggaaactttccgatctatgtatctgtactcatacagcctcatcgggctaaacagccttcttttcagaacagtagatcactcaactgggttttcaagtgactgtttacctttcaaggctggctttataggtcttgcctcactgtatccagcaatccaaactttaccctatcccagtcaggactgcacacctcatattgaaagacataccttagaaccagactccccaaagcttacaaatatcccacccttgactcccttttctgaggctactaagattatgtgaagacagtcatcttccttactgcagtgagcaataaacttggtttttgttcatcagtaaaccattttggtggtttctggaggagccagcagttggcaatggttataaatctaaatctaaaagccatgtataaaagactgatgaatctagtaacataaaaataaactgcatgataaatatcataaacaaagtcaaaagacaactgacaaccaggttaaaaacatgctttcaacatatattacaggaaaagggctaatattcctaatatgtaaataattgttagaaattaagagatcaagcacccattagaaaaaatgggaaaagggcatcaatagacaattcacacacacacacacacacacacacacagagacacacaaatggctttaacaactctatagaaacagaaagtaggtcatatctttgttctgtgaaaaggctgtgcacacaaagctattcccaaatgctgaagaagcccagaaaccaaagaaggaagtgaacaaatccagttcgtcagtaatgggtgatttattgaggaacttatggacagaagtgtgatcttggatgactgcaagacaggtagatctccacactgttatttcccagacccaaggtttgtgtaccatatggaaagggtacacatgctccagcaaaacgattaaaggcaaccctccagaacaggcgaaaatgctatgtgtgtcctagcctataatttgtgtgataacatcagggttgttttgatcttatactagggacagtaaataaagtagaaaccagaagttattcatgggactgggtctaatcagaagtcaacatggtggattagcgtccaagatggggtggtttttgtctccacaaccttaacaaggctgttgaaaaagtgatccataaatacacatataatcacttttcaaagtcaagaaacaatagatgctggcgaggctgtggagaaaaaggaatgcttttacactgttggtgggaatgtaaattagtacaagcattgtggaagacagtgtggtgattcctcaaggatctagaaccagaaataccatttgacccagcaatcccattactgtgtatataccaaaaggaatataaatcattctattataaagatacatgcatgtgtatgtttactgcagcactattcacaggagcaaggacatggaatcaacccaaatgtccatcaatggtagactggataaagaaaatgtggtacatatacaccatggaatattatgcaaccaaagaaaggaaagagatcatgtcctttgcagggacacagatgaagctggaagccatcatcctcagcaaactaacacaggaacagaaaaccaagcacctcatgtttctcactcataagtgtgagctgaacattgagaacacatggacacagggagggaaataacacacactcgggcctgtcagcgggttgggaagagggagagcatcaggataaatagctaatgcatgcagggcttgatacctaggtgatgggttagtaggtgcagcaaaccaccgtggcacacatttacctacgtaataaacctgcatgtcctgcacatgtaccccagaacttaaaatacaattttttaaaaagaaaaatacatatatatacctgtaaagtgcaaattcataactagaaaaatgcagattaaaaaaatgctaagctattatttctcacctatcagatgggtaaaaattaaaataaaattttaactaataaaatgtactaaattaaaatatgacaacacattttgttagccagatcttaggaaaataatcactcttttcattgctgttaaggaatacaaactgctacaacccttctcaagggaaacttggcaatacctaatataactacataaggagccctataatctcacttataaaatctaccctgaagatacatatccaacaatatgaaaaacatatgtacaagtttattcattgtaagattatatataattgctaaatttaagaaacaaatactcatatatagaacagtggtttttaaataaactctaataattcacacaggagagcactatgcagctataaaataaatgaggaagagctctatggattcatattcagagatttccaaggtatatttttatgtggaaagcaaagtacagaagaatatctagagtatactactcttcatgtaagaaagaagtatatataagaaaatatacatatatccacatatatgaggaaaaacatactggaaagttaaactagaaacaaatgagattcgtcacctacagaggttaagtaggatcagtgtggaaaaattggggaataaaaatgggtagaaatgattagagagatgtgacacactcagagtattcctatatgcatagctctaattcctataaatatggtaatgtttcacccccccaaaaaataaataattaaaattaaccaggatgttggggaagggaagacccaaaatggaatataagcagtaacaaataagcccaactgtattacaaataaatgacataattatactaaatgggataaaaaataaaagaattatctaacataacctggagaacattattttaaccatatactagaaggctaaaaacagaaagaactgtatgaaaattttgtactttagtaaatttgtttttcatagggtatgggttagtatttctgaaactactttatgtatgtactaggattgagtaattaagaaatacactgtggatattgagagccagttttctgtcagataaaagagttaaaatagagaaattgtgaagtagcacaaactccagattgaaatcagagcaggaatatcagtgtgaattcatggatatacatgcagtgagatcccagtagcaatgagcacaactagtttccagatcttggtttctaaataccattctcgatgaaaggaaccagagctccttggggaaatgactgagtccagactagagcaggaggaatgcaagatgagcttagaccatttaaagtgccagaaagtaaagacatgttcacaaaataatgggggccaagtctacaagacgtcggagccaacttaaaggagctactaatgcccaaatctggacaatttgaacaacatgatcaactgtgtgaaaggcaagtacagaagtgtatctagaatatattactcttcatggggttgttttacagttaacttttttttaataagtagaaggagtacactctagaataatgataaaaagtatagtatagtaaatacataaaccagtaacatagtcacttattatcattattaagtattatgtactgtacataattgtatgtgccatacttttacatagctgacagtgcagtaggtttgtctgcattgcatcactataatcctgtgagcaatacgctgtgttaccaggttatgaaagctaccatgtcactacatgataggaaattttcagttcaattataatcttatgggaccacccactatcatacatgtggcctgccattgacctaaatgtaattatgaggtgcatgactatatataaatatacatatgttggacattctgataggaaaatgcctggatatataagaaacaatgcttttacctctgaaaatctgaataagggaggctagagagatagaaagacttttactcttcatataataatctttttaaaaaataataaacttttaaaaatactgtcaatattatcctaggaagcatagttttatttctgttttcattaattaatttggacccagcattgatgaagtaaagtttaacttttattttagtttttctcgattgttgaatgaacattctttctcccagtttccaattatgttatctacattgaatcactgcttgactccatttccatatttgtagtgttagtccctggtaagacaataaacttccttataagcaaatttagaagcaattatttaattcaagcttgcacaattttctcgagtccagcacgagttgttgccacatctaacaatagcaaagtaaaggttgcaatgcttactagtgatgatttcttgaggaagaaaaataagtcttacttaacaatagaaaccttttttgtcttgctgcccaagtcaccaattttatataggggaagtagttaaaattaactaattatgacaattccagggtaaattaatttcttagaaatgtttcagagaataatactttctgcctcaaaagtatgcatttattatgtatcaaataaaattttaaatttagagaacattgaagaaatatgagatcagagaaatcaaagattattattaaattacatttcttttggtatctcctgagatttctcaattatgcattacttgtattcattcatttattcattaaatacaatatttatctaaaacctgctatgaccaagactgggtgaggaactggagacatagctattaaaaaaatagtatttatatttataagtgatgaaacaaaaagaaaaaatagaaggtgaatcggtaggtaaaaagagacaatagactaccagccaatctcaatgtgtgaaccttgtttgtatcctgattcaagaaaagacattaaaaagattatctgaaagagataattaaaaatctgaattctgcctggatagttgatgatattaaagaggtattattcattcttaggtgtaataatgacattgtggttatgttacaaaaaggagtcatttcagaaacagactgaaatatttacaaataaaatcatgtgttgtctgggacttacttcaaaataatgtgtgagtgtagggaatgggcagggttgcagtagggacaggattggccatgggttgatggttactgaggctgagcgatggcatgtgaggttttattattttattgtttactttcatctattttcaaaaagttaaaaaatcagccctccctttgctgaaaaaagaaaaaaagaaaagaaaaactacaggttttgtccctgcctcctggagctttcagttgtagagagaaagcaacacttactgagaaactaaaagatgatgtgtgttgtaaaatgagagtgcagggtgacattgcaattgagcaagctatcttgaggtagagagagaaggtagtcaaagattttgttgacagtttagttagaactaaaattgatagcgccattgtactccagtctgtcacagactgagatattatctcttaaaaaaaaaatggctgggcttactttgggaggccgaggcaggtggatcacctgagcccaggagttcaagatcagcctgaccagcacagtgaaactccatctctactaaaaatagaaaaaattagatgggcgtggcggcacacacttgtaatcccaactattcggcaggctgaggcacgagaatcgtttgaatctgggaggtggttgttgcagtgagccgagattgtaccactgcactctagtctgggcgacagagcaagaatctgtctcaaaaaaaaaaaaaaaaaaaaagcctataaactaaaattgagagatgggtggacttgtgtgggagagagaagataggggcatatgccagacagaaagcagcatgttcaaaggtctgaagcatatgtacatgtatgcagtttacatcctatataagtcaaaattggatgtaaagtttaaaagttagctgaatattttgtttacatatgtcatagcgtttatctgaagctgagcagggtatatccacattattctttgccatgtcatctccaattacatgcaagtaaattcaacaagatttgttctctgtatgagggacgtaaagttgaataactcatggtcacttaagaaccttacagtccaatggtagagacagatatatttgtctataccttagcaaagtaaaacatgaaaagatctgtactaatggaatgagctggatactgtgagtgtatttaggaggagtgattagttacgccttattagaacaacaaaaggctcagagaggagcatgccactagagctgggttttaaaagttaagtaggacttgattaggtagagaaggggaaagagaggccattctaagcagaaggaacaacgtgagcacagactcagactcaaaagtacatattgtatccaaggacctgcaggtaaatgatgtggttagaacacaggcttaaaataaaattaaaaatggcctggcgcggtggctcacgcctccagaactttgggaggccgaggtgggcagatcacaaggtcaggagttcgagaccagcctggccaagacggtggccaatatggtgaaaccctgtctctactaaaaatacaaaaattagccgggcatgttggcacgtgcctgtagtcccagctactcgggaggctgaggcaggagaatcgcttgaacctaggaggtggaggtttcggtgagccgagatcgcgccactgcactccagcctgggcaacagagcgagacttcgtctaaataaataaataaataaataaatacaatttaaaacatctgttcagtgctgtgataagatgtcatttgcatgtttatatttttctttttttttttttgagacagagtctcgctctgtcgcccaggctggagtgcagtggcgcgatctcggctcactgcaaactccgcctcccaggttcacgccattctcctgcctcaggctcccgagtagctgggactacaggcgcccaccaccatgcccagctaacttttttgtatttttttagtagagacggggtttcaccgtgttagccaggatggtctccatcccctgaactcgtgatccgcccacctcggcctcccaaagttctgagattacaggcatgagccaccgcgcccggccatgtttatattttccaaatgcttcacaaagaaataaatgcttcctggcttccatcacaggcattgcaggaaaggaattgtctaactagatgactacagataatacaaagcagtgaataaaaatagaaggcagttcagaatatgtttcagctctcgattctctaagaaattgatgacaagtacaactgagttaacatcaaagcatcaaaccaagcttttcataagtgaattcagccatcttcatggtgcctgggcttccttgctggctcctgtcctcctgttcacctctggatttggtagttcctttagacttggtcctaatcctttttctcttctcatgttactttttttcccatggctttgaatatatacttatgactccatatttagcaccaactcaaacctctcttctcaacctcagatccaaatacccaaatgctttcaaggcattcttacttaaatgccgcacaaatgtaagatgtctacagctgtacttgttcttttccatcaatcctgcctcacctccagtcttccacatcctaatgatgccaccttctactcggatattcaagccagaacctggatattatccctgactccatctccctcatgttacacattcaaactctcactaagaccatttggttctacctaaaattttgtcttgaatctctccatttctgccttctttactgctgccaccctagtataaactatcatcctctcttgcaacaactttccaaacggtcatctaccttccactattgcctatgacaatgcattctctatcttagaagatgaagattcggtaattcccctgattagaatcctttagtgacttccctctactctttgatgaaatgcaaaatcctaactaaggctagcagcttcctgaaagatctgcccctatctctccatcatttcaaatcatttgttgcctgtgttattgtcctattggtttttagggtcttaaatgtgtccagaaccagctcacaaccttcatgcttgtttttttgttctttccagaaagttattttcccctgtctcttggttggttctctctttttaggggaagcttttgctaggacttagaaagtaaaaatctgttccatcactcatcaagctggattaataaacattgataaaactagctgcaaagtttacgggaaactagttatcccaaagacatgcgataaagcttcataacaaccccattctttgagtgattactgttttcttacttgctaagaaactttgttctttaaaattatatgctattagaaaagaaacgttgtcgtttgaaattatattattataacataaaacatcatagtgtcttggagactctaaaacactttgacacagagaatcagcctccatttccattccagccacagagcttaagaaaagggcttctggacacaataatccatatctgtcttaactttctagttttcaaggaagcagaaccctggatcctgcccagacctgatgttgactcctgatttgctttgagttcatcaaaagccacttaaatggtttcaattaaatctcacccaaactctactcttcccccaaatcctgtaatgattatcttgtccttgtttggtgagtgagatgcctcacagttctgtgtgtgatctccctcactgcaatgaatctataaatatgactttgtcgaactctaagttgtttccttgcgcttgtagactgattgaggtaggacatgtgactcttcttcaaaaagtcttctctaaagttcccacgacaaaataggtcctcctaattcgttgtatcatcagcaccttctacttttctttcatagtgtattatatccttcaagaccccaaaggaattcgatacttaagtcaaaatatttggttaaaaatattaatcagttatatctgctccactttgtcggtaacggggtaaagtggaaaacaatccaaatgtccaatacttaaagtttgaagcaggttaaatattccttacctcccatactacatctcatgatgtttgcatggtgcataaaagttttgtaagcctgtagtaatttgaaagattaatttttgaccaatttgaaaaagtttttaagcaagttgaagaaccttgacaaacaagcaaagcgggactgattaactgaattagaaagaaaaaaaacctgaaatggtaaaaaaaaattatttaacacattctttttattgtttagtttcttatgtgtatttttatatatttattatggtattaaaccaaggaatatcttatgacaggaaagcaaaaacaatacaaaggacacagtaattccacctatctacaagtagtagaacttaacatctttctttccttaacacattatctcccactgaacacaacaatttttttttatttttttattttactttttattttattttattttttttttgagacggagtctcgctttgttgcccaggctggagtgcagtggcgccatctcagctcactgcaagctccacctccagggttcatgccattctcctgcctcagcctcccaagtagctgggactgcaggtgcctgccaccacgcccagctagttttttgtatttttagtagagatggagtttcaccgtgttagccaggatggtctcgatctcctgacctcgtgatctgtgcgcctcagcctcccgaagtgctgggattacaggcatgagccaccgtgcccagcccaaccattttttattttaaacagtcttgtcattgaagctttaatattattaatttctaagctccaaaacctgagggaggaaagggaaggctgaagtctcaagaaagagcaaagtagtgagatgactgagatgcaacttcctacctcacaagtttgtcttgggttaattctaagtcctaaaaactaccaagtatccactcagtaaatagctgttgaataaatgaatgaacagatgtctcaataagcaaaattggtttaatatgtctatttagtgttcaatttctcataaggatgttatttccatgtttaggataaaaattcaaaatagagttttcagctccttacattagctaaggtgggtgtacatttatctcctgcctggtacctttcctttctgacaagtttctagtctgctgtattacactatctaaaacagccactctgagctgactagcaccttatcactttagactttcctcacctcctctggcccggcacatctaatattttgtttaatcctaagtactccagttattgctcatgtcaagaacagacacattatcactggaattcaggctgaggaagaaactccactgaagccttcagtctcaacattaagaatcaaggaaggcctttatttatttatttttcaaataccagccatccttcatctgcaccccaaatcatcaaatgtttttatcaactctctgtaaaaattttgaatttcttaaaaaactgaaacagagatgataaatacaagtagccagttttaagtaccactgcttcttacttcaaagaatttcctctagatttgctattgtttgcaaaatatatagcggtggctcacgcctgtaatcccaacactttgggaggccaaggtgggtggatcacgaggtcaggagatcgaagccatcctggctaacacagtgaaaccccgtctctactaaaaatacaaaaaattagctgggcgtggtggcacgtgcctgtagtcccagctactcgggcggctgaggcaggagaatcacttgaacctgggaggcaaaggttgcagtgagccaagatcgtgccacttcactgcagcctgggtgacagagtgagactccatctcaaaaaataaataaataaaataaatatatataaaacatatattaaatattccagttacaaaaataacaattaccaaaaactccaacaaataatacctgtgcctaatatacagtgtggcaatgttcattatgaagttttaatacagagaactttttttcagaatttttaagagaataaatttttcttttaagaatacctaagccttatgaacatctgatgttcaaatacccagcaatggctggtcgtcttttgcttgcctaaactccatctgaacaatggcaaagctctgctgaaccaaccaacataaggaattgcacatccccacatttctttccatctttttcttttctgtcagactttcactcttttgctgatagtaagtacccttaatctattaaaagaaatacaaaaatcacttctgacttgcctattctgtttcattatatgcatatttacatcaccactgtatgacaaattatttcacctcatagaccctgttttctgatctgtaaaagtggttaatggtacttacctaaaaggttgtaaaattttttaaaataaagtatgtaaagctttcagtgcaatgccttgtatttggcaagtgcattgtaaatgggagtattatctacatcaacatcttcatcaagattacaatactgctgtgactcattcctgattaaggtcatgcattacttaacaaggatatagtctgaaaaattcatcatgaggtgattccatcgttgtgcaaacatcatactgtgcacttacacaaacagagatggtatagtctacaacacatctaggctatatatggcattgtctattgttcctaggctgcaaacctggacagcctattattgtactgaatactgtaagcagttgtaacataatggtcaatatttgtgtacctaaatgtagaaaaggtacagtaaaagtaaactatagaagatataaagtggtacacttaggccaggcacagtggctcatgcctgtaatcccagcactttgggaggcagaggcaggaggatctcttgagcccaggagttcaagaccagcctgggcaacatgatgaaaccctgtctgtaccaaaaaaaaaataacaaaaaacaaaaattagctgggtgtggtggtgtgtgcctgtggtcccagctacttaggaggctgaggtgcaaggattgcttgagcccaggaggtggaggctacagtgaggttttttctttttcattttcttttcttttttttttttttttttggtttttttttttttgagacggagtctcgctctgtcgcccaggctggagtgcagtggcgggatctctgctcactgcaagctccgcctcccgggttcaagcagttctcatgcctcagcctctcgagcagcttaggacacaggagtgtgccaccatgcctggctaatttttgcatttttaatagagacagagtttcaccatgtgggccagactggtctcaaactcctagcctcaagtgatctgcctgcctcagcctccctaattgctgggattacaggtatgagccactgcacacagcctataagctttcttctatttaaaaatttttatttattttttactttcaaacttttttgtttaaaaatgaagacatagccaggtgctatggtgcaagcctataatcccagctactcagaaggctgaggtgggaggattgtccaaggccaggagttcgaggctgcagtgcaatatgattgcacctgtgaacagccactgcactccagcgtgggccaacatagtgaggcctagtctcaaaaaaaaaaaaacaaaaaacaaaaagacataaacacacattacacatgagactaggcctacacagggccagggtcttcaatatcactgtctttcacttccctatcttctcccattggaaggtcttcaggagcagtaacatgcatggagctgccatctcctatggtaactatgccttatctggaacacctcctgaaggactgttttgcagttaacttttttttaagtataaaaaagacactctaaaataataagacaagtataatatagcaagtacataaacccataacgcagtcgtttattatcattatcaagtaccatgtactgtacatattgtatgtactatacttttataggactggcagcacagtaggttcgtttacaccagcatcatcacaaatatgtaagtaatgtgttgtaccatgatcagctctgacatatctgggcaataaaaatttttcagctccactgtaatcttaaggaactaccactgtatatgaagtttgtcattgaccaaaaggtcattatgtggtgtgtgactgtaatataaaaatagctattgtgataaaattattttaagggagggagacaatgggttgggaagtaaaattagtcattttgttagttttttattgctgctgtaacagattatgacaaacttaaacattaaaataacacagatgggccagaaactgtgactctcacacttataagcccagcactttgggaggctgaggcaggaggattgcttgagcccaggagttggagaccagggtgggcaacatagtgagaccccatctctacaaaaaataaaaaacaaaattagccaggtgtggtggcacatgtctgtagctccacctactcaggaggctgaggcaggaggatcatttgagcctgggaggttgaggctgtagtgagcccagaccatgccactgcactctagcctgagcaacagagcaagacctgtccctaaaaaaataaaaataaaaaaaaacaacacagatgtattgttgtatagatctggagatcagaagtttcaaatgggttggcaaggctgctttccttctggaggctctaggaggagaatccatttccctgtctgtctcagcttctagaggctgcccacattccttggatctagcccccgcatcactctgacctctacttcatcacatcaccttctctccctttgtctcacatttccttttttataaagatccttgtgattacattggggacatcagataacccaggataatctcccaatttcaagatccttaacttaatcacatttgcaaattctcttttgccatataacgtaacagtgataggttctgaggatttgcatatggaaataatggaggccattatttagtttaacacagtcattaaaaaaagaaattggggcatttaaccttctagaaactgaattgaaatttctccataatcaatagaaaactttctattttctcaacactagtgaaacctgcttttctttggtgacaccagttgataaaaataaaactatttctgattcaatatgttgctttcccctttggttatcagtagtttaattgaattattgactacagttttatggcaaatgtgaattctgggttgaacaaactaaattgagatgcaaataccaatttgtaacattgatcctgtgggtgaataatttcatagtcccaacaaatgtacttatgtttaccaacttgcaatacaaggtctttttaaaagtaattaatttatttttatttttatttttttaaagacagggtctcattctgtcttgcaggctgttgtacagtggcctgattatagctcactgtagcctcgaaattctgggctgaaatgatcctcctgcctcagcctccaaagtagctgagactacaggtatgtgtcaccacacccagctaaattttatatattttttctagagacaagggtatgtagcccaggtatttgaccctccaaatctgatgttgaaattggatacccagtgttggaggtggggcctaatggaaggtatttggctcatggggcagatccctcatgaatagattaatgttctccctgggttgcaggtgagtgagtttttggtctcttagttcctgtgagagctaggttttacaggatttttttttttttaggctggtcttgaactcttgggctgaagagatcctcccacctcagcctcccaaggtgttgagattacaagcatgagccacctcacctggccaagagctagttgttaaaagagcctagcactaccctcctctttcttgtttcctctctcaccatgtgatctccacacacattggcttgccttccctttctgacatgagcggaagcagcctgaggccctcaccagatgtggatgccagtgccatgcttcttgtacaatctgcagaatcattagctaaatacacctcttttctttataaattacccagccttgggtattcctttatagcaacacaaacagagaaagacatatgcaatttgccattttaatcatttttaactgtacaatttggtggtattaattatatttacaatgttgtacaaccgttaccaccatctattaccaaaaccctttcgtcaccccaaatagaaactgtgcttattcagcaaaaactcccactttcctctccttccagcctctggtaacctctggtaacttctaatctacctcctgtctctatgaatttgcctattgtaaatatttcacataatggtatcatacactatctttttgtgtctagcttatttcacttagcataatgttttcaaggttcatccatcttatagcatgtatcagtattccattcttcttttctatggctgaataataattgtatgtatatactgcatcttgtttatccatttatctttttgtttgtttgtttgttttttaaagacagggttttaccatgttggccaagctagtctcgaactcctgaactcaggtgatccgaccaccttggccttggaaagtactgggattacaggcgtgagccatcgtgcctggcctatccatttatcttttgatagacattttggttgtttctaccttttgtctattgtgaataatgctgctatgaacattagtgtacaagtcactgtttaagttgttgttttcaattcttttgggtattgtattaggccattcttgcattggtataaagaaatacctgacactgggtaagttccaaagaaaaaagggtttagttgcctcacatttctgcaggctgtacaggaagcatagcagcatctgcttccggggaggcttcaggaagcttccaatcatgatggaaggcaaagtgggtgcatgcatgtcacatggcaaaagccagagcaagagaggaagtggggaggtgctgcacacttttaaacaatcaaatcttgtgagaactcacaatcttgatgacagctagagatggtgaagccattcatgagaaaccactcccatgatccaatcacctcccaccaggccccaactctaacactggagattaattatatttcaacatgagatttgcataggaacaaacagtcaaactatatcaggtatatacttaagagtagaattactgggtgataattctgttttacgttttgaggaattgccaaactatcttcctcagcagttaaaccatttacattcccaccagcagtatactaggtttccaatttctccacatgttcaacaacactagttattttttcttctaattatagccattctagtaggtacaaagtggtatctcattgtggttttagcatcttttgagttgcttattgaccatttacatgtcttttttttagagaagtgtctaagtcttttgtccattaaaaaaattgagttatttatcttttatttgttgagttgtaggattctttatgcgttcaattcttttgggtattgtattaggccattcttgcattgccataaagaaatgcctgagtatattagttttttgtcagatatatgatttgcaaacattttctccaattttttgtgttatcttttcactctctttatagtgtcacttgatacacaattttgatgaagtccaatttatcagttgtttcatcacttgtacttttgatgttatatttaagaaaccgttgtcaaacccaaggtcatgaagatttttcagtatgttttcctctaagagttttatagcatttaatatttaagtgttttatagcattaaattttggtctttgatccattttgagttaatttttgtacattgtgtaaaagtataggtccaacttcattcttttgcttgtggatatctagtttccccaacaccatttgttaaagagattgtccttttccccattgagtggtcctggaacccttgctgaaaattaattacccatagatgtgagtgttagttctggcctctcgattctattccattggtctatattgtctatctctgtgccaagtccatgctatttcaattactatagctatgtagtaaattttaatatcagaaaatgtgatcctacaactttgttcctcttcagattattttggctattttgggttccttgaaattttatatgaattttagaataggtttttccatttctgccaaaagcgctgttgggattttaatagcatgattacattgactctacatatcattttgagtagcgttgtcattttaacaatattaagtcttccaacttatgaacacaggatctctttccatttatttaagtctactttaatttctttccagaatgctttgtagttttcagtgtacaagtcttctgccttcttggttaaattgatttctaaatattttattcttttgggtactactgtaaataaaaaattcttaatttccttttcagatcttttactgctagtgtgtagaaacacgactgatttttgtgtgttgattttgtattctgaagctttgctaaatttgtttattagctttaagaggctatttttggtattctttagggctttctacacttatatcacttgcaaatagagatagttttacttcttcctttctaatttggatttattttatttctttttcttgccttatgggtctggctagaactgccaatactatgttgaatagaagtggcaaacacaggcatccatggcttctgattttagtggaaaagcttgaaatttttccccattgagaatgatgtcagtcgtgagtttttaatacatggtctttatcatgttgagacagttcctttctattcctggtttgttgaacagttctatcataaaggaggaatggattttctcaaatgttcttctatatcaattgagatgatcatgagtttttcactccttcattctattacttggtgtattacatcgactgattttcatatgttaaaccattcttatatttctgggacaaatctcagttggtcatagtgtaaaattcttttaagggctgctgaatttaatttcctagtattttgttggggatttttgtatctataatgcattcataggggacatttggctatagttttcttgtattgtctgtctagctttggtatcagggtaatgttggcttcatagaatgactcagaaagggttctgtttctcaactttttggaggagttcgagaaggattagtgttaattcgtttctaaacgtttggtagaattcaccagcgaagtcatcagttcctgggcgtttctttgttaggagagttttggttgctgattcaaccaaaattgaatatcattactttttatagatctattcagatttattctttcttcttgagtcaactttgttggtttgtgtgtttctaggaatttgtctatttcatctaggttatccaattttttgacatatagctcttatacgaattctcttacaaccctttttattcctataaatcagtagtagtgtttttcatttctgattttagtagttgagtattctttttccttaatctagttaaagctttgtcaactttgttgatctcttcaaagaactaatttgttgtttcattgattctattgtttttctattctctatttcatttatttttgctctaatccttattatttccttcctctttatggcttcaaactcaattgaacataaagtattaagaaatttgat

SEQ ID NO: 142 - DNA, 1597 bp, Homo sapiens
tatcaccagaaccattcaagtgccacgaaataacacatttatgtattattctgcttcaggtgagctcaggaggaaaagacagatatctattcactaaaaatattcttttgattggccggcacggtggcttacacctgtaatcccagcactttgggaggctgaggcaggtggatcacctgaggtcgggagttcaagaccagcctcaccaacatggtgaaaccccgtctctactaaaatacaaaaaattagccaggcattgtggcacgcgcctgtagtcccagctactcaggaagctgaggcaggagaatcgcttgaacctgggaggcggaggttgcagtgagctaacatctcaccactgcactccagcctggtgacagagcaagtctctgtctcaaaaaaaaaaaagttattttgatcaacttcttatggacaaagttcagaaagcaaagaacaatgttttactacatacacatacacatgcatgcacacaaactagaaaaaaaaatttttttgagtgctttgtctggcatctggcgatggtgtttcccgcaccatctggcctgtggtctgtggggacgtacatacgtcttgttagggctctccatccagtccacacatcaatggcttgcctggcttacgtagtctgagcaggtgcccagctttgtcgcagatattgaagccgtgtaaaataaatgccttttgattgttcacactttaagcaatattggtacaatattaaacccattgtcccaggcactccctctccttactgcttatggcacttcatgtattaaaaaatgacagtggcagcattgcccagacatgcgttttgtcatcaagtcttaatgcagtccacctggtccctcaggcaaatgaatggaggcacagaagatgaaatgattttcaaaatgccattaggaaagctcaggccagaactggaaatgggtcccgcacagggcactcggccactcttgcctggccatctcctttttggcactaagccacaagcacacaatgatatagaatgaatggttatcactggggatccagaagggtcattcaatcagttctcagtcttatcaggtctaagttcctttcttatcaggtcctaaaggcctaatcttatcattgtgacaaagataactgtagagtctgttaaacttttttttaataacatgaagattatgatttatagctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagc

SEQ ID NO: 143 - DNA, 5374 bp, Homo sapiens
tggggaaaaagatttgttaaattgcctcctaaatctccaaagaataggaagaacagtagatcagcttagctctttcaaatcagggcaatgttgggctaaaagaacagcaactccttccactggtttaatcatgttggtctccaactgctttaggaatgttgttttatgttagaattctttcttgtaagagagttttttaaattatagaagtaattttttaaaatgtcaatttataaacttgaacacctctttcctgactcctttaccaaaattcaggttggcgagcactttgccgtattgagcgacgggttagtgactttttttaaagtggttcttctaagaaacagacagttcagaaactgcttctcagacttcagtgtgcaaacagattccctggatagcttgttaaagatgcagatcctcattcagtaggtcgagagtggggctcaagatcctgcacgtctaaacaagccctgacatgatgctcatctgctggcccatgtacccactttgagtagtagcaagcagatttttttaaatgttttatatatcaacaaatattgttagttttttatacaggaaatcaaacttccctttcttctttattcgttctcttctccctccaccttcctctaacctttccacaaagagtaaagggtatttgatttgcattgattgctgaggtgtttacgtgtatggcaatgaggcatcaactagcagtgcccttgattggagagattaggaagagttatgagaagaaatgacaaaaagttacttaaatttgagtataaatagcccagcgtgaggaacgtgaacactgagatttaaaaaacaatgaactctataatttacttatacatttaggccctagctaaagatatgcccccatcttcctctggactctactttctatttggggcccagtttggagtgggggcagccaggatgattggagacgtgtcactcttaggattaccagtggtaggtttggtagccaacctgaccctgtacgtcactccatttcatcctcatctgttcatattgaactgccacgggcaaagatgaatatgacgcagtcacctctactgtctgggaactcagtggtggggcttaggggccatgtcagccaattacaaactgaattctggggaggtaagtgctgtagaggaggcagacagctggttgaagggagaggggtcaccacagagccgccgaggagtctgggccgacttcatggggccggggagaagccagctggtgtggaaggccagggcggtgggtaaaatagcaacatggtgtgacataaatagcaccaactgcagcacgctgcagggagctccagagcttagaagggaagttttgaagaaaggagttctttggtccttaaggagagaagagaagtatttgctgtgggggctgggaggagggggtcaatgtcaggaaaagagtgtcacctagagccattcagagggcagctctgaggaacttcctggagatggctgcaggggtccttcctggtgccctgccctgtgaggggctggccgcagggtgtcatgcggagacaaagcttttctcagggacagctgtgtcttttgacattgcaaacattcccccgccagccccttgtcctgttagcaaactctgaagagatcttttcacagagttgcacctgaagtcgcacaggaaaagggcgccttcccactctagatgcccttcttgtgcagctttcaggaagcaggtttcatgagaggctagtgtttggtgcatgagtgataccttgttcagaataaaacagggggacaaatattcttttttcaatttctgatcttttttttaaaattattatttttaaaagggagatggggtctcactatgttgcccaggctggtctcaaactcctgagctcaagcgatcctcttgcctcggcttctgaaagtgctgggattacaggcataagccacatgcccggcctctgatctcttactataccactttctcgctacaccactgctgtcgtctatttgctgaatgtgttacaataggaagctgtgagtagtttggtgattttcaaactcgtttttaaggcaaagaaaagcctttagttgaaggaaattatatgcataaggtgtaaaaatagagctccctgtttgggagtgagtgaaggtcgacacctaagagcctgaagccctttggctacccttctccccatcctgtgccatcgccagatgacctgagggagccccgtggaaccactaaccaggaatactcaatgtgggcaccctggcccagcagataggcatcaccccggaatgtgtaagacctcctgaatcagaatccgcattttaacaagactgcagattgagaacttctgatctggagcctttctaatcactgacaacatccgcagtgggaaaagcaaccacactggctctgagggccactgtctatcttggctctgccctgcaccccagtcgggagctttaccacgccagcagactggcctgcgttcccatttcctcagctgaaaggtggaaagaatattacattaatgaggacagttcatgtgagcttacgctaggacttcatttaatctcacaatctgaaattaattctcacaattctgacaaccacgtcaggagcactgtagacattacgaccaccctaggttttaaatatggaaatgaaggcaaacggaggtgaggtgaacatttgtgactacccagccctgaaatggcagcttttctgactaaaaatccagaggactgcccccatttcagcgccatcctctcagggctgtggcaggggtgacatgccacaaagtcatgcttcctaaacatccctaccgacacagcccccatggaaaagagatgaatggctggccggccgggcgtggtggttcacgcttgtaatcccagcactttgggaggccgaggtgggcagatcacttgaggtcaggagttcaagaccagcctggccaatatggtgaaaccctatctctactaaaaatacaaaaattagccaggcatggtggcgcgcacctgtagtcccagctactcgggaggctgaggcaggagaattgcatgaacccaggaggtggaggttgcagtgagccaagatcgtgtcactgcactccagcctgggtaacagagtgagactccatctcaaaagaaaaaaaaaaaaaagagagagatgaatggctgagggtcgatgggcgtggctcggagatgcccactgcaaaatctaaactctaaatccctgggtttattcttaacaatttatacaagttttgcattcacttcctcatatagctgagtttatttaatataaaaataatgtttcgagaaacagagcttgaagcaaaaccagtgtttctgaaagaaacactgtttttgctgatcccaagcactccaccaacaccctccagggggcaagcaactgaacctcaaattgagaagcaggatatgaaggaacttgacaaattgtccaaggcaactctgaagtacggaattgttatctccagaaatcctgacatcacaaatatgacagttctctcacccctggccacaccaccgctccgtaactctctatggattcctggatgacaatctcctttcctgcaaaccgataatgctcctgagtgtagctggcgtaatctgtaggaacaaatttctggaggctatgaagagatggttctatcttgttggattctgtgaagcagaaaaataaaatggagttcatgatttgttcaaatccagtgcaaagacacacttggtataattgctaagatggcattagattgaatgacctttacataaagagaagggatgatgctatcaaggagaacggctgcaaattggcacaaaattgaattatatggggtgatggggacatgaaatttggatgtgacagttttatcagatgacaaaatgccaaagaatgctctgggccttttctttatttaggggaggacagaagatgtgtggatcggtccccaccctaaattttgctgatggaaaaatggcgaacttaccagcaaaattgcacgaatgagctgtctggatacagaggaactaggtaaacacaaacctgcctttttttttttttctttttgagacagagtctcactctgttgcccaggctagagtgcagtggtgtaatctcagctcaccgcaacctctgcttcccgggttcaagtgattctcctgcctcagcctcctgagtaactgggattacaggcgtgcgccaccacgcccagctaatttttgtatttttagtagacacggggtttcaccatgttggtcaggctggtctcaaactcctgacctcgtgatccactcgtcctggcctcccaaagtgctgggattacaggcgtgagccaccacgccccgccagacctgcctatttttaggtcttgaagtgaagtaacattcccacgtgttggctggagcatgttccttcaatctttcctacaattgctgttcaaaaggtagaggcccagccagccccacagccctgggggaggatgtcagctgagctctggctattaagttactattgctttaaatactcctttaaacccatgacccatctagcagctctcagatggcatataaaatgagaggaaaagagcacctgatcgggctgacatcaagagatcacaagtgtttgcaggttttccagagtgtttaggaataaaagagcagtgagtcaaagtgtgtggaagaaggagcaggagcagaggaaaaggtgttggtcccagcgggtgggaaagaattaacagtgcggagagtaggggggaggaaggtcagttttgtttgcacgaaacctgcctttgtggcctgggatatgactgtaaaatgtttaaccgggggtcaaatatgggctttggacaaaggtagaagggggcagccggtgaacattggaagtgttttaatctgaaatagcctctcaaggtggaaggcaggaggaggtgaatacgaggcaaagggaagtgggtcttgggagaaacctggtcagcagggcatccctcaggtcgggggcagggcctccgggtgtttcaggtctcactcattccatacacactggaacagttccctgccactgctctgcaaatgctgataacagctccacagtaagtagagggatttggagtgagcctttagaaacagtcacaaccatttgacgatgcctgttgaatctaactacaaacaaaacccggagcttgtattttatatgtctgtatatattttcatttaatttctctagaaattcatttttgttgtatattacaaaagtatcagtgtgcagcacactaaaaaaaaaatgtgaatgaagtgactcatttgtaaattagcatcatgggtgccttcagttc

SEQ ID NO: 144 - DNA, 3325 bp, Homo sapiens
tgagtagtttggtgattttcaaactcgtttttaaggcaaagaaaagcctttagttgaaggaaattatatgcataaggtgtaaaaatagagctccctgtttgggagtgagtgaaggtcgacacctaagagcctgaagccctttggctacccttctccccatcctgtgccatcgccagatgacctgagggagccccgtggaaccactaaccaggaatactcaatgtgggcaccctggcccagcagataggcatcaccccggaatgtgtaagacctcctgaatcagaatccgcattttaacaagactgcagattgagaacttctgatctggagcctttctaatcactgacaacatccgcagtgggaaaagcaaccacactggctctgagggccactgtctatcttggctctgccctgcaccccagtcgggagctttaccacgccagcagactggcctgcgttcccatttcctcagctgaaaggtggaaagaatattacattaatgaggacagttcatgtgagcttacgctaggacttcatttaatctcacaatctgaaattaattctcacaattctgacaaccacgtcaggagcactgtagacattacgaccaccctaggttttaaatatggaaatgaaggcaaacggaggtgaggtgaacatttgtgactacccagccctgaaatggcagcttttctgactaaaaatccagaggactgcccccatttcagcgccatcctctcagggctgtggcaggggtgacatgccacaaagtcatgcttcctaaacatccctaccgacacagcccccatggaaaagagatgaatggctggccggccgggcgtggtggttcacgcttgtaatcccagcactttgggaggccgaggtgggcagatcacttgaggtcaggagttcaagaccagcctggccaatatggtgaaaccctatctctactaaaaatacaaaaattagccaggcatggtggcgcgcacctgtagtcccagctactcgggaggctgaggcaggagaattgcatgaacccaggaggtggaggttgcagtgagccaagatcgtgtcactgcactccagcctgggtaacagagtgagactccatctcaaaagaaaaaaaaaaaaaagagagagatgaatggctgagggtcgatgggcgtggctcggagatgcccactgcaaaatctaaactctaaatccctgggtttattcttaacaatttatacaagttttgcattcacttcctcatatagctgagtttatttaatataaaaataatgtttcgagaaacagagcttgaagcaaaaccagtgtttctgaaagaaacactgtttttgctgatcccaagcactccaccaacaccctccagggggcaagcaactgaacctcaaattgagaagcaggatatgaaggaacttgacaaattgtccaaggcaactctgaagtacggaattgttatctccagaaatcctgacatcacaaatatgacagttctctcacccctggccacaccaccgctccgtaactctctatggattcctggatgacaatctcctttcctgcaaaccgataatgctcctgagtgtagctggcgtaatctgtaggaacaaatttctggaggctatgaagagatggttctatcttgttggattctgtgaagcagaaaaataaaatggagttcatgatttgttcaaatccagtgcaaagacacacttggtataattgctaagatggcattagattgaatgacctttacataaagagaagggatgatgctatcaaggagaacggctgcaaattggcacaaaattgaattatatggggtgatggggacatgaaatttggatgtgacagttttatcagatgacaaaatgccaaagaatgctctgggccttttctttatttaggggaggacagaagatgtgtggatcggtccccaccctaaattttgctgatggaaaaatggcgaacttaccagcaaaattgcacgaatgagctgtctggatacagaggaactaggtaaacacaaacctgcctttttttttttttctttttgagacagagtctcactctgttgcccaggctagagtgcagtggtgtaatctcagctcaccgcaacctctgcttcccgggttcaagtgattctcctgcctcagcctcctgagtaactgggattacaggcgtgcgccaccacgcccagctaatttttgtatttttagtagacacggggtttcaccatgttggtcaggctggtctcaaactcctgacctcgtgatccactcgtcctggcctcccaaagtgctgggattacaggcgtgagccaccacgccccgccagacctgcctatttttaggtcttgaagtgaagtaacattcccacgtgttggctggagcatgttccttcaatctttcctacaattgctgttcaaaaggtagaggcccagccagccccacagccctgggggaggatgtcagctgagctctggctattaagttactattgctttaaatactcctttaaacccatgacccatctagcagctctcagatggcatataaaatgagaggaaaagagcacctgatcgggctgacatcaagagatcacaagtgtttgcaggttttccagagtgtttaggaataaaagagcagtgagtcaaagtgtgtggaagaaggagcaggagcagaggaaaaggtgttggtcccagcgggtgggaaagaattaacagtgcggagagtaggggggaggaaggtcagttttgtttgcacgaaacctgcctttgtggcctgggatatgactgtaaaatgtttaaccgggggtcaaatatgggctttggacaaaggtagaagggggcagccggtgaacattggaagtgttttaatctgaaatagcctctcaaggtggaaggcaggaggaggtgaatacgaggcaaagggaagtgggtcttgggagaaacctggtcagcagggcatccctcaggtcgggggcagggcctccgggtgtttcaggtctcactcattccatacacactggaacagttccctgccactgctctgcaaatgctgataacagctccacagtaagtagagggatttggagtgagcctttagaaacagtcacaaccatttgacgatgcctgttgaatctaactacaaacaaaacccggagcttgtattttatatgtctgtatatattttcatttaatttctctagaaattcatttttgttgtatattacaaaagtatcagtgtgcagcacactaaaaaaaaaatgtgaatgaagtgactcatttgtaaattagcatcatgggtgccttcagttc

SEQ ID NO: 145 - DNA, 10194 bp, Homo sapiens
ccggctttaggagttttattaggtgccctattatggaaaataaactttaatcccaccataaaaaccaaatctgaaaaacatacttgcccttgtggtcgggagcgccgcggcatccctggtggaggtcacacctccgacgggattagttttaaggagggagacagcgctccgcaagactttgataccggggggctggggggcgcccccttcgccgccgcgccccacgcgggtcccagcgcccctccgcgccgcactcccctcccccggacggttccgcccggcagccccctccaagcctggggcgcactcagcgctgccctccgctggcgggggcgggggcggggtgggggagggaagggggaggccgcgggtcagttgacccggaaacctgagaggtgctgaggaacaggcccgggcgcccctccggagcagctcagcaaggaggggctggggtcggaggcgaggagagggagagcagagggaagaggaaaaggaaggaagaaaaaacaacaaaattatttttacaatcattgtgaccattcacgtgttagtaccggagggttaactatgtgcattatgcaacagacgctagaactttctcatcttcccaaactgaaactctgtccccaagaaacaccgactccccagtaccccactccgaaccactagcaacccccattctactctcttagagtttgactcatctaaactgatatttcacacgatcttgcggcatttgtctttttgttcatttgcttgcttatttattactatttttttttagagatgaggtctcacactggcccaggctggagtgcaatggtgccatcatagctcactgcatcctggagcccctgggctcaagccatccttccgcctgggctccgcagtagctgggacggcaggagggcacccccacgcagggccactgtttgtcttttgtaattgggtatttcactcagcataaagtcctcagagttcatgggtgttgtagcatgtgacaggattttcttctttttaaagcctgaatggcgctccaccgtatgtgtgtaccacattttcctcatccatttctctgttgatggacacgtaggctgcgtccacctcttggcaattgtgaagagtgctgcaatgaactcgggtgtgcaaatgtctctttgagatctttttgttttttccaattcttttggatatatacccagaactgagactgctggatcgtatggtaatttgactttttttttttttttttttttttttttgagccctgtcgcccaggctggagtgcaatggcacgttctcggctcactgcaaccttcgcctccagggttcaagcacttctctgccccagctcccaagtagctgctactacaggcgcccgccatcacgcccggctaattttttgtatttttagtagagacggggtttcaccaccttggccaggctggtcttgaactcctgacctcgtgatccacccgccttggcctcccaaagctctgggattacaggcgtaagccactgcgcccagcctgatttttaattttttgagggaaattctgtactattttacataatggctatgccatgttacattctgaccacagctgcaatttctccacattctcaccaacacttgctattttctgtgctttttgtttgttttatattggccatcttagcaggtgtgaggtggatctgtggctctgatttgcatttccctgatgcttattggtgttgagcatcttttcatatgtgtgttgccgtttcaaaattttatttggagtcatatctattcaagtcatttgcccatttaatttggttttgttgtagagtgctgagagttacataatctgaacattaacccattccctgattcgcgtgttgcagatgatatctcccatccccaggttgcctttcactcttgttgatcgtcctttgtggcgcgtacgtttttcagtttgatgcagtcccatttgtctatttttgctttggttgccttgtgttcagtatcaaagaaggaaagtcaccggatgagggaagggacaggtccacctcctctcccttcgagctgtttctttactccctgacaccagggattaaccggggtctcctggctgcctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccccgggtcgcagtgacggccgccgcaggggtctccccccgcgtaccttcgcttctgttgaaggcagtgagatccgcaggcctccgggacagctagaggacagcagacatgtcccgtgggggaagcctgggcctgtctgaaaacaccgcctcagctccctccggggtccccctgcgtagacctggcttcaggtccggagaaccggattcttgagggctgcaaagactttctcccccatgcgcggggtcagctggcggctcaggtgcgattggaggcctgggccccgagggaccaccgccccaggccgagccgagtcagcgaccccgagcgcggcgcccaggggtgggggtcgcgcccgcaaggcgggcagagccgggcctcgagaccgttcattaggcagaatgaattgttcaccgtgcccggagtggatgaggacgagccagtgattatatttaaatttgctataattgatttggggaagagctactgtgacaagaacgaattgatcattaaatttattagcgagataaattccgcggcgactgagcggcctgctggaggcgcaggggccggcgcaggtccggggcctggctctgctggaggacgggggaggggcggccctattaacagcgtcttcctttgatgtcgctcttccccgcgtcccagaggaagcgcctgtcccctgggggtagagggacagaccctccgcggaggcctggggcaccccagctccaggccgagcccccactcttccctggctgcccagtgttggtgagggcgctgaggctgggccggctgagcccaaggggaaaataatccccagatgtggggccagccaggggagagattgctgcaggctgaacctcaccaatgtgttagaaattaaaaagaaatgtagggattgcagattaaaaaaaaaaaaaaaaaaaaaaaaaaaagcatctgtcttccccccttccctctggttttcccaccctcttcctctgggcactctgcctcctccaccagtggcaaaccctctcccagttcccctaaacacctttggaccccaggcggcggaggcccggcccctgcgccagcgcccagcagctgcttctgcccggactcccagcagccgcgccccggccttggatgaggttgattttatggaaggggcccggggtgataatgagttgccagagaggatattaatctccccgcgccctgaggcagaggagtggctgcgctcgccccgcggtaatcacccaaatgaaacgccaggcccttctgaactcattttatccgctgggaggaggggaggggaggagggaggagaagggcacacgcaggtgctgctgagaaagtgacaaacagaaggaaggaggaaggcccgggagaagggataggagcggcgtccccgtcgcccgtctcctccggggccaggagaggccactgggtcatcgatgggggaagggggccgggagtcgcgccgggctgggtgggccgcgggcctgcgctcctgggcggacgagagcgcgggctgagcccgcatgtgtgcagcacatggcgctgggcctggctgcggtgattgatggcgcgcgctgcagaggctgattaacccggagccgctgcagccgcggtgtggagcgctgctgcagtccgccgctgtcctcgcggacttgtttgcacagagccaagaagaccgatcctggccagccaaggaaggttctgctaacagagagggccggggtcgaggagagagagaagcaccgcgcaattcggtgcgttccgggaaatgtgcctcagtagcgcctgaggtcacagggaccccacatgctactaacgcctagtcgttttaagcttattttctgaaacgtccaaatagcgtatttccacttctggagtgccaacgaagcaacagctagcaaggaaataggaaaataaatagagtccacagctccgcttccgagggacacgtgtcccgggacaggtgtgcaccaggcagccgggcatgcgctgacacctggccacaggtatttttgccaacacttcacattgcgactccccagtagcaggcgcggaggtggtcctgacacccacttgagactccgattttcaccctcagctgccaaccgccgagtagacaccctccccatcatttctacaagcaaattgtaatgccgcgggcataatcccccaaaactcgtgcacgctgatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcccggctcctccgcgccgcccttccccgcgcccccgccgccgcccttctgtttctccgcttcctgcgccgcctgctctttggcctttttgctgcgtttccatttcatccgccggttctggaaccaaatcttcacctgcgggcacaagcgggcgtgagaaaccggccaccgccaccccagggcttcctgtccccggagtcccccggccgcgtgcgcctgggccccattgggtcggccctggaatggcctcagggtgagacgacttagaagcagaatggggagggggctcgtagcttcctcctccccgcaaccccccactcagcagcaaaccccagagctgggctggagctccgtgggagctaggactatgtccccaacgacccaggccggggacttttctacccgcgccctccgtctgcggaggaagggtcagggcagctggctacgtcgcggtaaatctcaggatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgctagatgcctcagaccgcccgtgggtcacaagtgcaaaggtaacagtgtcccctgggaggccgggatgcgtcgggggcggggagggcgcgcacctgggtctcggtgagcatgagcgaggtggccacctcgaagcgcttgggccgcgacaggtacttgttgagcttgaactggtgctccagctccagcagctgctggctggtgaaggcggtgcgcggccggcggcacttccccaggaggttcgactgcgcctgggctggggaccaaagggcagtgaggcccacagccggctccggtcctcgccccagcccctcccgttgctgcttgtaccactacactcaaggccccagcgccaaggcctggccctgcagagggcggggctgttccctcactatcagtgcccactccccaaggaatgcggactcaggaccaccaagtggaaatggatagtttggagttaatgagaccaatttttttttttttttttgtctaggagacgtctgagtgtccctgttaaacagggcccatcgcaggaggcttcctctccacaggagccggctttggtagcagtggattgacccagaggcaagaggagaactgaggccagtcgggggccaggaagggaggttccgggaagcccaggagttgaaggctgcagtgagcgagactgcacccctgcactgtaccctgggtgacacagcaagaccccatctctcaataaataaaaaataataaaataataaaataaaggagcagtgagtgatgagaaccaaatctctccccctctcctcactgcgccttcctagagattcaggctcagatccaaacaggtctgggaagagctggtcctgctgttccaggtctccctgcactgcctccttaagacagaaaaggaggaggaggaggagaaaaagaggaaggaaggaagggagagagggaaagagggagggaggaaggaaagaaggaaagaaggaaggaaggaaggaaggaagggaggaagggaagggagagaggacaggtggaacaggaccaaacccagggtccaagtctgtgtattcaccagggaccctcccaccttccaaatgttttccttggcatgccccctcctcagggtgcgggcggcaggggcaaggcctgaggagactagaagccttttcaggacaattctcattacgcaaattacaggcagaggcgcaggcaggatccggttctctgtgtgttcaaggaggcctgcccggctttatttacataatttcgcacggttacatcacagagaattttatgacctcaaaacgagacttcccttgatttcccaggagcctgacaagtgttggacaataaaagaaagaaagcaaaggaaagaaaggaggccagccccaggcctggatgagctcaggtcccccgggatgggcagtttgctttagaggatggcccacgccccctgctttagtcaaacaaggccccgaattcccaacttgacaatacattagaactttaattaaaccactggctccggagggaccatttgggaaatgccatccaacaggcagagacaaccaattaaagaaaccaaacaggttttccccggaccagcgaggaggacttctcagaacacattccgccgtctttggcacggttatgcctgcccttttggattgccaggtgcagatacctcttctgaacttaagactggttgtgtttaaaatttggccaactctaggtcaacatttggaatcagaaataggcaaggtgtctcactttaataaattttctgagtgaccctgggctccacgaagctccagaaagcacccctaggaggcctaggaccacgggcccccggggctggccagccccctccgtgggcaacttagcgtccttggctctgggaaatgcaggtcatattggtggctttctatcagaagggatgggccctgggtcggcaccctgggtttaagcccaggctggcaggggattcgcagacgcagacgtgtctgaggtgaggggcagctttccctcttccagccagtcagtagggctgactctcccaggtgagggatgggtgaccactggggccttcttggagctgagctaggaaagcctggggcggctgtgggcaaacagccttctgcagggattcttctcaccctcttgtgacttctccagcctctggggtcctagattttctctgtttagtcacaaccacagcttccagcaaaggaatctgaattctggagtgtttatttctgttttcttttttgcttttcccctgctctgcctgcatctccccagtctaaacaaatccactcagacagaaacaatggggtctctttgtttgggtgttcggcggctgaaagcgttgagccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctccgaagcccatttctcttgtttgctgctcctgaagcactccctctccctggaggggccgcgggtctctctaacgccccagtgggggacctggcccaagttcctttccccggtgataagccctgacccccattcccgggcctgcctaattcagggcgctctcggctcgccttcccccggcgacttccttctcctgcagccttcgggttaatcattagatctcagtctcacacctccaactgccccttcccgttaagagaggaagagaaggcaaggcctgcgcatggccattttaataattcgctgcccgtctcatgcctgggggtccgggcgagtcctcgcaggccccgggcagagccgaggcggcttcgcagctcttcccccgctcgctgggagccaagcgcagagaggggcaggcggtgccggtggaggatgcgcgaggccctcccgccacgcgcatccacgggggccgcagggtactcacagttgaagtcgggcatcttaggcaggatcatgcccgcggtggacgcgcgcagccactggtccagctggaaggtgccggcgcccagcttgatggggtcggcggggtgcgcggggtgcgcgccttgcacctgcgggtacgagtaggagagcgccgggtgctggcccgccagcgcagccgccgccgccgccgcggagtagccgtagaccgggtggccgtagagcgccgcctgcgccgggaggcccgcgccgccctgcgcgcccccagggtgcagccccagcgccaggcccccagcggcggcggcggcggcggcggcggcggcagcggccgctgcgcccggatgcgcgtggtggtggggccccccgtgcccgccgcccgtgccgccgccgccgccgcccgcgcccaggaagcccggcttgggcagcagcgcgcagtgcgcggccagcaggcgcggcggcgacgggctctcggcgcgcaggcggtcggcgggcgcagccggcggctccgaggacgcggggctgcagctgccgctagtcccgccgctcgccccgccgccgccgccgccacctccggtgccagatgcggcggcggcgagcgacgtgaccaaggccagcggcgcgctctgcgcagaggcggctcgtggggggtccaccgccagcagggcgtcgatgcggaaatttttggatttttccatcggctcgtttggggctggcgctcagggcccggtggcgggcgacgcggccgtgtgcgggctcgcggagtcagtgcgtgcggtgcaagcccgggggctcgg

SEQ ID NO: 146 - DNA, 4774 bp, Homo sapiens
ccggctttaggagttttattaggtgccctattatggaaaataaactttaatcccaccataaaaaccaaatctgaaaaacatacttgcccttgtggtcgggagcgccgcggcatccctggtggaggtcacacctccgacgggattagttttaaggagggagacagcgctccgcaagactttgataccggggggctggggggcgcccccttcgccgccgcgccccacgcgggtcccagcgcccctccgcgccgcactcccctcccccggacggttccgcccggcagccccctccaagcctggggcgcactcagcgctgccctccgctggcgggggcgggggcggggtgggggagggaagggggaggccgcgggtcagttgacccggaaacctgagaggtgctgaggaacaggcccgggcgcccctccggagcagctcagcaaggaggggctggggtcggaggcgaggagagggagagcagagggaagaggaaaaggaaggaagaaaaaacaacaaaattatttttacaatcattgtgaccattcacgtgttagtaccggagggttaactatgtgcattatgcaacagacgctagaactttctcatcttcccaaactgaaactctgtccccaagaaacaccgactccccagtaccccactccgaaccactagcaacccccattctactctcttagagtttgactcatctaaactgatatttcacacgatcttgcggcatttgtctttttgttcatttgcttgcttatttattactatttttttttagagatgaggtctcacactggcccaggctggagtgcaatggtgccatcatagctcactgcatcctggagcccctgggctcaagccatccttccgcctgggctccgcagtagctgggacggcaggagggcacccccacgcagggccactgtttgtcttttgtaattgggtatttcactcagcataaagtcctcagagttcatgggtgttgtagcatgtgacaggattttcttctttttaaagcctgaatggcgctccaccgtatgtgtgtaccacattttcctcatccatttctctgttgatggacacgtaggctgcgtccacctcttggcaattgtgaagagtgctgcaatgaactcgggtgtgcaaatgtctctttgagatctttttgttttttccaattcttttggatatatacccagaactgagactgctggatcgtatggtaatttgactttttttttttttttttttttttttttgagccctgtcgcccaggctggagtgcaatggcacgttctcggctcactgcaaccttcgcctccagggttcaagcacttctctgccccagctcccaagtagctgctactacaggcgcccgccatcacgcccggctaattttttgtatttttagtagagacggggtttcaccaccttggccaggctggtcttgaactcctgacctcgtgatccacccgccttggcctcccaaagctctgggattacaggcgtaagccactgcgcccagcctgatttttaattttttgagggaaattctgtactattttacataatggctatgccatgttacattctgaccacagctgcaatttctccacattctcaccaacacttgctattttctgtgctttttgtttgttttatattggccatcttagcaggtgtgaggtggatctgtggctctgatttgcatttccctgatgcttattggtgttgagcatcttttcatatgtgtgttgccgtttcaaaattttatttggagtcatatctattcaagtcatttgcccatttaatttggttttgttgtagagtgctgagagttacataatctgaacattaacccattccctgattcgcgtgttgcagatgatatctcccatccccaggttgcctttcactcttgttgatcgtcctttgtggcgcgtacgtttttcagtttgatgcagtcccatttgtctatttttgctttggttgccttgtgttcagtatcaaagaaggaaagtcaccggatgagggaagggacaggtccacctcctctcccttcgagctgtttctttactccctgacaccagggattaaccggggtctcctggctgcctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccccgggtcgcagtgacggccgccgcaggggtctccccccgcgtaccttcgcttctgttgaaggcagtgagatccgcaggcctccgggacagctagaggacagcagacatgtcccgtgggggaagcctgggcctgtctgaaaacaccgcctcagctccctccggggtccccctgcgtagacctggcttcaggtccggagaaccggattcttgagggctgcaaagactttctcccccatgcgcggggtcagctggcggctcaggtgcgattggaggcctgggccccgagggaccaccgccccaggccgagccgagtcagcgaccccgagcgcggcgcccaggggtgggggtcgcgcccgcaaggcgggcagagccgggcctcgagaccgttcattaggcagaatgaattgttcaccgtgcccggagtggatgaggacgagccagtgattatatttaaatttgctataattgatttggggaagagctactgtgacaagaacgaattgatcattaaatttattagcgagataaattccgcggcgactgagcggcctgctggaggcgcaggggccggcgcaggtccggggcctggctctgctggaggacgggggaggggcggccctattaacagcgtcttcctttgatgtcgctcttccccgcgtcccagaggaagcgcctgtcccctgggggtagagggacagaccctccgcggaggcctggggcaccccagctccaggccgagcccccactcttccctggctgcccagtgttggtgagggcgctgaggctgggccggctgagcccaaggggaaaataatccccagatgtggggccagccaggggagagattgctgcaggctgaacctcaccaatgtgttagaaattaaaaagaaatgtagggattgcagattaaaaaaaaaaaaaaaaaaaaaaaaaaaagcatctgtcttccccccttccctctggttttcccaccctcttcctctgggcactctgcctcctccaccagtggcaaaccctctcccagttcccctaaacacctttggaccccaggcggcggaggcccggcccctgcgccagcgcccagcagctgcttctgcccggactcccagcagccgcgccccggccttggatgaggttgattttatggaaggggcccggggtgataatgagttgccagagaggatattaatctccccgcgccctgaggcagaggagtggctgcgctcgccccgcggtaatcacccaaatgaaacgccaggcccttctgaactcattttatccgctgggaggaggggaggggaggagggaggagaagggcacacgcaggtgctgctgagaaagtgacaaacagaaggaaggaggaaggcccgggagaagggataggagcggcgtccccgtcgcccgtctcctccggggccaggagaggccactgggtcatcgatgggggaagggggccgggagtcgcgccgggctgggtgggccgcgggcctgcgctcctgggcggacgagagcgcgggctgagcccgcatgtgtgcagcacatggcgctgggcctggctgcggtgattgatggcgcgcgctgcagaggctgattaacccggagccgctgcagccgcggtgtggagcgctgctgcagtccgccgctgtcctcgcggacttgtttgcacagagccaagaagaccgatcctggccagccaaggaaggttctgctaacagagagggccggggtcgaggagagagagaagcaccgcgcaattcggtgcgttccgggaaatgtgcctcagtagcgcctgaggtcacagggaccccacatgctactaacgcctagtcgttttaagcttattttctgaaacgtccaaatagcgtatttccacttctggagtgccaacgaagcaacagctagcaaggaaataggaaaataaatagagtccacagctccgcttccgagggacacgtgtcccgggacaggtgtgcaccaggcagccgggcatgcgctgacacctggccacaggtatttttgccaacacttcacattgcgactccccagtagcaggcgcggaggtggtcctgacacccacttgagactccgattttcaccctcagctgccaaccgccgagtagacaccctccccatcatttctacaagcaaattgtaatgccgcgggcataatcccccaaaactcgtgcacgctgatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccg

SEQ ID NO: 147 - DNA, 5704 bp, Homo sapiens
acagagataggagggtattagaagttagagatgggtatgtgttataatagtctgggtcaggcaagaactttataaaagctcagattccggggtaacacccctggaattctgagtcaatgggtgtaaagctagtcctcttaattctagatgaaatgctaaacatgaatgactggtaggaagttaaagcatcaaagggagaatatccttgatgctgacccttttagaagaatatcagaaacccataaaaattataagcagatgcttcatttttaccacaaatggatactgactcacctggatcagggtcatattttaggtccagtggatgtacaacagggtggtactgcttctaaacataacataaattaaaacagatttaatcacttaatgcttcatataaacatctctttcagctaatatgggagatatactatagagtcagtaccattcttttgaggaaaaaaaattaaatcctactgtctgtagggaagaggaggtgagaaggtaaaaccaaactaagtctgaattatgtcttttacagtactgccacctgctgcatatactaagaagtggcaccataaaaaagtataatcagaaaaagcaatcaagcaaattaaaagcatagaaactgaattttatgtttaaagtacagggtagtctccaattatgaagggactgtgtttcaaaagttcattcaggacaagtgtttagaactcaaaatgcatatttccatgaaaactcagttctaaaaggtggcgaggctacattaccaccacactaagcctatatatcctgcgacacactgaaattatagtagcagaattactggcacagaatctacaatgcaggcaaaaagaaagaggaaattgctcttccttattcttgcccaaagccagcagaagccaaaaaggttaaaagaaagaaaacaagaagaaaaaaaggtcttcagccagctgtggtgactcacacttgtaattgcagcactttgggaggcccaggcaggagaatgtcttttgctcaggagtctgagaccagtctgagcaacaaggagggaagaagggaggaaagacgcagggcagggcagggcaggaaaaaattttgaaaaggtctttggtatcctcaccttatctattttgcattactttttaaactaccacagcagtacctcacctaggccagccatctttcttttctgcaatattgattactagttttgggggtttaggggtagtggggcagtaacaagggcaacactgaaaaatacactttcaatgtttttcctgaaaaaaactttcaagtgggaggggtgggggaagtgatggaatgcggtatttgagaactgctataaagaaaattaaaaattctgctcatgaatactgtttttcacagaataactaaaatgttttagatacaatattaagccgggcatataatgacctgaaacaatcctgaaactgaggcaactagaagatttatatgtgaacatttatgtactaatttcaaaaactaaaggcaatagtatagcacaatctaaacacaacatgtacctcactggagggacaatgctattcccagcaaacctcccctccccaccaagggaagatttgggtccaattttcttgtggatttcctattttttatttattctagtcctaataaatctgaaaagatgagggtgtgatatggttggtcattgatatctatagtaattataagaaggaagtctacggctctgcttgtctaaaaagctcgtgctgaaggagctgaattcctggtcttgtcacccagatgttcatgatttttgcagcaaaacaaattacacccaattcataaagcaaatttcagtgttatgaacaggtactaaaacaatcttcatcatcaatttaactaaatggtcttccaaaatatacaaacatacaaatatatgccaaaaaaaaacaacaaacagaaagaaaagtgttaaaagaaaagcttctttttccatccttgtctcagaatcataaagtcattgtcagtcttccatcaccaatttcaattttaaccactcactataactttcatttttttcatttttgaaccagtgtgttcaaaacacagtatagtatgactatactatgtcatagtacaacttagaagagtaaagtcttacaagagacaaacaatactaattgaggcaggaaagaaaaagacaacaaaatgtcacttatctccacgtagagccttatattttaatgtttttattgtggtaaaatatactataacattttaaaggcaaatcatcttaccagaatttcttgttttgcttttatggttttgatgacacattccaggatctttctgggatactgcttacgttttgtggctatatctactatgatttcatcaaactgatcttcaagtactttgatgtcagaatctatttgagaaaaaaaaatgtatatataaaaagttccctaaaactcattgtttacattctgtatggaaatgtgctataaactaaatttagaaaacacaaaataatgaaggaaaacaaatatggcaagttaatgaatgcccccactttggtgattaatttatttacgcattgaacaatcaattattgagcatctataagaagccaggcctaaacaagagaaatacaaagatgagcacaacatgattcctactctctaagagttcacagtttgctgaaagaaacagacaattgcaaggcaacctgataagtgcaatagaggtatgagcaaaatgccatcaggacacagaacaatggaaaactgactgactgtgaaatataagactttaaagaagtaacatttgagcttgaaatagaagtataagtccaatggataaaaagtggtacgggaaaaaaggaatagggagaagcattttaggcagtggaaacagtatttgcaagatcctagtctttggagacctgagaaaagttctaaatggctacagaataaagtaaaggagaaatggatgataaaatatataagaaccaggctgtaaagggtatttaatatcagggatgctaagaagttttgacttattatgaactgacccaaagctatgacagtagcagtgagtggagtaactagatctgaaataggactcaactggattgatggtaggaaaaactgaaagatacagtgagtttagagtttctttcatttagctaactctactttatcatatgctttttcatgttttaaaacagtgattctcaaatgttagaagaatcacctaacgagtatgttaggagtacagattttttttttaatactttaagttctagggtacatgtacacaatgtgcaggtgtgttacatatgtatacatgtgccatgtcggtgtgctgcacccattaactcgtcatttacattagatatatctcctaatgctatccctccccactcccccgaccccacaacaggctccagtgtgtgatgttccccaacctgtttccaagtgttcccattgttcaattcccacctatgagtgagaacatgcggtgtttggttttcaggagtacagaattttgattcagtaagtctgagatggggcccagaaatgaagcaccctagatgaaaggaatgtaggtgatccatctaactttattttgaaaatcattttaaagagtaaaaatactaagtagttacaaatactaaagagctaagttcttagcttaactggtcctcatattgctctgttgtgtcaaagtctaagctagaaatggacctatttattttattgatcagaagctttattaggaagaaatctaacatctgaaacataatttttgaaacattttgagaaattgctgatatgtttcggtatatacatatcagataatcaagtatatcaggtatagtctttcattcatgtcacaaatattaattgaatcccactaaattagttcttttgagggcaccctttttttcctttttctctttctttccttccttctttctttccctttccttcccattcattctccctcccttcctttccttcttttctttcctttcctccctccttctttcctagatagatagatagagagagagacacacacagattgattttcaatagcttttggggtacaagtggtatttggttacatggatgaatagtacagtggtgaagtctgagattttagtgcactcatcacccagtagtatacattgtgaaagtacccttcttttgagggcaagaaataatagttatttcttactttgaataattatttatataagcagccctccctaaattttcatttatccattaaaaaagttaaataattagcctgaagaaaataatgtactatttcacaattagttaaaaaaaaaaaaaagaaaagtctcccaggtaaatcttttttgtagagaggaacatgctttcttagcactacctagtgataaagctacaattaaaatgtatcacaaaatttgaacagaagccaggcacaggcctgtaatcccaacactttgggaggccaaggcaggcagatcacctgagtttgagagttcgagaccagcctggccaacatggtaaaaccccatctctgttaaaaatacaaaaatgagccaggcgtggtggcaagcacctgtgattccagctacttgggaggctgaggcatgagaactgcttgaacctaggaggtggaggttgcagtgagctgagatcgcgccactgcactccagcctaggtaagagtgaaactctgtctaaaaagaaagaaaagaaaaattgaacaggaaagaattattcattaatttaacatatttcataggtgcctactatgagccaagagttgagaacaaggtcaggagcagtggctcacatatgtaataccagcactttaggagattgaggctaggagtttgagaccagcctgggcaacatgatgaaaccctgtcctctaccaaaaatacaagttagccaggcgtggtggccacatgcctgtaatcccagcaactagggaggctgaggcacaagaatcactttaacctgggagacagaggttgcagtgaactgagactgtgtcattgcactccagcttgggtgacagtgagacttcatctcaaaaaaaaaaaaaaaattgtctttttaaggaaccttctacaaagatgtaacctcatcctttacacggtacttgtataattaataataacttcacacttttaagggtacttcactattcactctagagatcacttacaaaaatacaacttgctttgtaaataattacagaaattccctgggcctcttttgtcatctggagatagctctacagtattttccaataaactattgacaaagaagactattgaagtcataatctcagttctttattactcccctagtaaacaacttcttgaaaataaatgacactaaatatggagattaaaaaacagcattcaaaacaaaattagctgcaaaaataacccagaaattaataatggaaggaaaaagtcacatacccataaaacaattatctgaagcttcctgccatgcttgcccattaatgctgatattctcttgcacagctgattcaaaagtctgcaataaattcacagtagtcaagtcactaaaaataattttaaatactaaattcaaacgttttagcaaaataatacttccagatttgtgacagaggaaataaaagtagcagaatagctaattagtatatctattcttttcaat

SEQ ID NO: 148 - DNA, 10846 bp, Homo sapiens
cctttgttaaccagtgtgtcatataacagcaatcattttctgtggatgaataatgagggagatggtaagaagcatgacctggagtagactgcaccgccatccgcctctccactttccctctctcactgcatccttccttctgactgcggcagagacaggccgaatcactcccctgtgagaaacctctggatggggggccatcccctcaccaccctgaggaccaggtccacattccttactgtggctgacaaggccctccatagcttccagtgtccccttcccgcctccactcctgtgttcgtgagtagaattcggtgctccagaaacatcacgcctttctgcagccctctcctctattccgtgctgtttctcaccccagcttcttggctcacacggtttcacttacccaatacgctaataacatggaggttaagaccagcggtggcatcaggtaacccggttcaagtcgttgctctctgtcacttgttcatggtgaaagcactcaatctctctgaaccccaatttatacctcagctttaaaacaagtacctatctcagggctgttgtgaagatgaaatgaagaaaatatgcagacataagtggttgctttctttatccatcttgcttaactgccctaacccccaagaagtcttccctaaccctccttctgaaggaccctgtgcaaaactctgcaggcgccatgcgctgactgttgtctgattatttctctgccctgcttggctgaggtctcccaggcatggagtccctttgagattcatctccagcctgggtgggcccactggggcccatctgtcaaggacagagcaggaggtcctccggagaaggtgacaacgtagtggggcatcgaccataacaaatgcgggagctccagggaacgacccccgcccgctggcgtctctccagtctgagaccccactggaggagctgtccatgtggctgcctctcgccttttatcccaggggacagagccaacgccaagcatggcaaccacccaccttaacctaatcaggatgcagcctgctcattaattcattcattcattcagagggatctgtccgggtgcgggtccagcacgggtccaaatcctgcatctccagtagcctcctgggggtcggtcgtcgggagggctcgtgagcggaaggctttaggatgaagcgacagggcccagagtcgtggagattggactggggggcaggggagcaggcattgacaaccacgccgacaggggcatcccgcgcgcctgtgtgggagaatgtgtagggcaagcagcagggagagaccatctcagagacaggggaacagccaagcagaaaccactgtgctgggcgcggggggaggccgggaaagacagcacatctgcggggcgggaggaggggagggaagggagtagaaacactgctcccgccagccgcgggtgatggggacacgtgtccagctcgctgagtccgagggcctgggcccgctttgggtgccctgtttctccggcgcccaggtgtgtgcgcagaaccgtgtctgctccagggacagccgtgaacgagcgccgtccggagtggcagggccatcaggtgtggctcattccaagaaaggtccgtaccttcacatgtaaacttcctggcaaagctgctgggttgccgcttatgggagaaggcggcgggcccaaggttcggcccctttgtctgaatctggcatttggagcaggctttaagacttcgggaaaagccgggcccctgtgcaaccaccaaaggctgcttctcccgccctcaggactaagatcttgttccagtcctccagtcctcggggtctactccaggggtacaaggtgagagtggctctccagagtccatttgccttttggtgccgcactgcatcctcactttgaccctgagcgctgcagtaagccctgcagggtgctccaccttgaagcacgggaagatctgatgctggccgccttcttccttcggttgcctgaaagggcccgtgtttatccttcgcttcacagagaacgcaacacacaacattaaacacacatagagagtgaaagagaacaaggcatcttcatcaaggagggcgcaccatttaaccacccgcgaccttgcagtgcgcctctgcaaagtggggactccgctctgtagcaggagatgggggtgttgacgattttgaaagtagttctcagttttccgaggcaaaggtgtctggggctgacgaatgacttttgagaagaaggaatgatgagaaatgtcctcattacagaactttcccggccacactgtgagtcccacgcaaagaccccatgaccaccaaccggagcgctgggtgctccctggcagggtcacctttgctttttgcgcgcccccatgccacccctggggcaggaggccatcctcttatcctgggagtgcaggcctggcccgaagtgcagcccccgaggccgggagccgagattcttctcggcttcgtgctcagagctttgcagcgtggcatggtttcctcctcttgccctgttgctgtttcataccagggggaactgagacccagtcgggttatgggcctccctgagaacactggcctctagcagaagcagattcaaccccaggcctcaacctgcgcccagacccgtgccctggagtggagtttacccactgccgcccttcctgggcaaatgtcaccgctgcctccgtccccctaggtccggggcgggtcagtgcttcgagccagcggaccccggcctagggacaggtgcctgcgagaatgcggggggcggcccccagctcccctgccctcctccctagaggctgggcctgctggtctcccggctgcgcgcaaggtgggaacgcggccgacttggtccgctcgccctccccgcacccgctcctctggagccgctggggctgcgcaccgactcacccgcgcggcctccgggctgcgccttcagcgctggcggcgtcctgcccggcgagggccagggtcccaggaggccccggaggcggcgggaccgcagggcggaggggaggccgtgggagcggccgggcgcgcctcagcagcgcggagactggggccgccgccgccggcgcagggcgggccgggagggaggaggagcgcgcgggcggggccgccgtgtacgtccccgcgctcccgcccggcctggccccgcggtcccggagcgagctggggccgcgctggggagggtcctgggggcgccgccgtccctcgggccgggcaacgccgggcggggaccggtctcgccccgccgcgctcgggctccctccccggcggcccctcctcggcgaacagcctttcggcgcggggggctgttaaaccagacaccccaggccacactcctctcgttcgaaatgaccatttcggggttctccgtggcggggagctccgccgccgccgtcccccttccacgcgcgggaggtcggcgagggcagggcggggacccggagtgcggcccccggtcctgcttcgtggcccgaaacgcctcgcaatggagtcactcatgacaggggactcagcgcacggggcggctgctgagccccgcagcgatcggcgggcgtgaggggttccccggcgtggttgcccgggagcctgtcagccccagcagccctgacaggaaagggaagtcgagaggaggctgagcgaacggccgccacccccgcgggacgctgacccgggcggaccccgaggggcctctccccgcgccagagcgcggcgtgcgcggggaagcgcgacccaccggggtcggcgacggcgcgcggggcgggcgcggcggttccctctcctccgcccgtgcccgtgggatcggcgggcttgtcgggctgggagagcctcgtggaacccgggcatccgggcagcagcggcctccgagccactgtggaggcgcccggggtcggcacggcgaggccgacggggacctgacacggtcacgcggcgccggggagcaggttcgagtggccgggcgtggccgtgctgcccctccgcgttccgcaggcggcgacgggcgagcggccctagcgggctgcagggaggacgccgcgtggacggagagccggcgcccgggggccagatcccctcccgggacggggcgccaggtccccgcgagctgcggcgcgacgcgcgggcacccgtgtcccacccggtggcctcgccgctgcgggctgcgctgagagcggggtggcgcgacgcggtccctcaccgcagggggaagacggcaccaccgcgtcccggccgctggagcttcccgcccgcgccgccggcccgacgctgccccctggcgggagagcgctgcaggggccccggcgaggccgcaggacccgacctccccgccggcctcgcactcccgcgccgccgccgagggtcggcagccggatcgccctccgtgccccatagcacccctcacactaaaaacgacgactttattaagatgtgaggtattctatacatacgataaataccaggaaatttaagtacagtacatggaagtatacagttccatgaattttttcctttattttttagatacagggtctctgtcgcccaggctggagtgcggtggcacgatctcggctcaccgcagccttgaacttctaggctccagcgatcctcctgcctcagcctcccgagcagctgggaccacaggccccgccaccatgcccggctcagttccatgacttctgacacgcgaaaccaccaggctagtctccccccgagttcaagaagtcctctcctcccaaaagtaccctcctgcccctctgcagctaacccctcacctcccctccgccctggttccagacaactgctcctctgatttctgtcactgccctttgcctctctcgcaattgcatgcaaggagaaccattcaccgtgtggtcttttgtgcctggctttcttcgcttggcaccatgcagctgagcgtcgcccgtgtggcgtgtgtgtgttgtattttcctctaccttggtcttgagacctccctggagagccactgtaaaggccaactctgccctgacagggctcctgggatttgggcgtgggtgtttgccgtgggcctttcatggggcacctctgtatcctggctgacctgtgaccgggtgtccctctcccaggagacatatttatcctggcagatctccttgtgcttcttgtctgacctgtatctagtttattcctaccaagatagctgctctctagggaaagccctgaccagggaaaacgttacgtttgagcgtctcagtcaggcatgacacagagcaggcaacacaacgaaacacaggaactaacagaagtggtcctattacttacagatccacaggggaagagggcacactgagggccgtcgggaatgtcttggggacactgtacacaatcgttgtgggggtggggggagccagagagagacggacctgtgggctgaggcttttattggagtgcagggcattactcaagcagttttcccaaggggagctctaattggttcacctagaggagcgaactggagtcctgtggggccaccttgtgacttaggggtggtcactgagacatatctgcatagtccatgcagggtgtgggcgtcagtggggtgagtctagttggttgtatgtatacatcccacaaggaggcagttaccaggaggtggctacctaggaccagatatctggacggaatgtgttgagatactgtttccagcagagagctggaaactgtatccaaggtgactaagccctgcttctagtatgaaattgttaaccctatattcaaaatggatactgaagcaacctaaaatttcaggtatttactaaagtgtgtatcaagttccctccttaccactggtgagtagtattccattgtatggatatgccacaggctgtttgtccatttggacattgatggatggactaaagttggccaagctgggctggtggggaggcaccctctcaggaccccaaaggaggatgcggggttgttgttggatgtctgggttgtttccagtttgaaggcattgtgaataaaactgacttgagccttcctagaaagttttttgaatatacatatgtttcatttctctcggataaaatgcctggaagtaggcgggatggcttggttgcatggtgagtctttttttaaaaaaatttatttaattaattaattaattaatttttttgagacggagtcttgctctgtagcctaggctggagcgcagcggcaccatctcagctcactgcaagctccgcctcccgggttcaggccattctcctgcctcagactcccatgtagctgggactacaggcgcctgctaccaagcccggctattttttttgtatttttatcagagacagggtttcactgtgttagccaggatggtctcgatctcctgacctcgtgatccatccgcctcggcctcccaaagtgctgcgattacaggcgtgagccaccacacccagacttttttttttttttttttttttgggatggagtctcgctctgtcgcccaggctggagtgcagtggtgcaatcttggctcactgcaacctccgtctcctgggttcaagtgattctcctgcctcagtctcctgagtagctgggattacaggcttgcgccaccacacccaactaatttttgtattttgggagagatggggtttcaccatgttggtcaggctggtcttgaactcctaaccttgtgatccatccgccttggcctcccaaagtgctgggattacaggtttgagccactgcgcctggcagcatggtaagaaattgtttttcaaagtggtcatactatttgacattaccaccagcaatgcatgagagcccatagcattctatggtttgtcttttcattttctttttttccatgagacagggtctcatgctgtctcccaggctgcagtgcagtggtataattgtagctaaatgcaatctcgaactcctgggctcaagtgatcctcccacctcagccttctgagtagctgggatgataggcacacgccactatgcctggctaattatttttatttcaattttttatctttagtagagatgagatctcgctatgttgcccaggctggtcttgaactcctgggctcaagtgatcctactgcctcagcttcccaaaatgctgggaatacaggtgtgagccaccacacccacctgttttttcattttcctaatgttatctttcaaagagccaaagtttctaattgtgacagcgtccaatttattaaacattttccttgattgcctaccttaaggtaaggttgcaaatattttctcctatattttcttctagaattgtatagttttggctttttgtttaggtctatgatacactcaaactaactttatgggtggtgtgaggtaagaatcaagggtcttatttatttatttatttatttatttatttaagatggagtctcattgtctccctctccctcgccctcgccctcgccctcgccctcgccctctccctctccccacggtctccctctgatgccgagctgaagctggacggtactgctgcctgattctcctgcctcagcctgccgagtgcctgcgattgcaggtgcgcgccgccacgcctgactggttttcgtatttttttggtggagacggggtttcgctgtgttggccgggctggtctccagcccctaaccgcgagtgatccgccagcctcggcctcccgaggtgccgggattgcagacggagtctcgttcactcagtgctcaatggtgcccaggctggagtgcagtggcgtgatctcggctcactacaacctccacctcccagccgcctgccttggcctcccaaagagccgagattgcagcctctgcccggccgccaccccgtctgggaagtgaggagcgtctctgcctggccgcccatcgtctgggatgtgaggagcccctctgcctggctgcccagtctggaaagtgaggagcgcctcttcccggccgccatcccatctaggaagtgaggagcgtctctgcccggccgcccaacgtctgagatgtggggagcgcctccgccccgccgccccgtctgggaggtgtgcccaacagctcattgagaacgggccatgatgacaatggcggttttgtggaatagaaaagggggaaaggtggggaaaagattgagaaatcggatggttgccgtgtctgtgtagaaagaggtagacatgggagacttttcattttgttctgtactaagaaaaattcttctgccttgggatgctgttgatctatgaccttgcccccagccctgtgctctctgaaacatgtgctgtgtccactcagggttaaatggattaagggcggggcaagatgtgctttgttaaacagatgcttgaaggcagcatgctcgttaagagtcatcaccactccctaatctcaagtacccagggacacaaacactgcggaaggccgcagggccctctgcctaggaaaaccagagacctttgttcacttgtttatctgctgaccttccctccactattgtcctgtgaccctgccaaatccccctctgcgagaaacacccaagaatgatcaattaaaaaaaaaaaaaaaaaaaagatggagtctcgctctgttgcccaggctggagtgcagttgcatgatctcggctcactgcaacctccgcctcctgggttcaagtgattctcctgcctcagcctcctgagtagctgggattacaggcacccgccacaacacctagctaacttttgtatttttagtagagacagggtttcaacatgttggccaggctggtctcgaactcctggcctcaagtgatccactggccttggcctcccaaagtgctgagattacaggcgtgagccaccgtgcccggccaaggctcatttttagatatagatctagatatccacttttctagtaccatttgtcgagaaagctatctttaccttgacacctttgtcaaaaatcacctgtggttaatccagtgctggagataagcaggaggtgctctgggtgccttgagaagggggcacccaattaatccagccaggtctagtccaggaagccttcccagaggggcaacaaaggaatccaggcagagggtctgttggtagcttagagttgtgtttttgtggattgtgtaggtatagcggggtgtggggaagacgtagagctagaagtaggcaggacccagattggggtggggcggggacctcatgtgctttgctaaggagcatgcactttttcctgggagtgatgaggggccaccgagaggcttaggcagggaaataacacagccagactctggcagtttggaacattgactccggctgaggaggaaggactgaaggaggttaaaatggaggcaggctggccagtaactgggaggtgatgataggaagggaaatttcctctgattattctttttgttttctcttttagttagaggtggagtctcactaagttgcccaggctggtctcaaactcttggcctgaagcaaccctcctgccttggcctcccaaagtgctgggattataggcatgagccaccatgcttggtctaccttgttttaagagttgactttcgtatcatgctggagaatgacctattctaaataaatgccgtggaattcagtaggtagaagccacaggacttggtgactgttttggagtgagactgacagaaagatgttctgtctgggggagtggttctcagccttctttcagactgatcatgctggacttcctgccagaggctctgtgtctgagggccagcagggaggcccaggcctccgtgttttacaggcctccacggtggcttctgatgtacagccagcattgagaaccactgctccaagttgacagcagatctcatacttggcaaatgggtgggtgatagttccagtcccgacacagggagcacagggggtggagcagatttagggggagtttaaatttggttttaactacttgacactttgaggtactgttgggagatttccatgcagaggaaagttgaatgtgtgggtttaaagctcagaagggaaggtggactgggaaaacagtctggttggacatcagcacatggagcaggggttaaccaggagcttgtaaacccagggagttatacagacagttttatgggtatgcatacatgtacactgtttttcctggggcaaatagggtttctgatttcccagggcccatgaccccacaaaggttaagagcctctgatgaggacagtggttgatccatgggacaaaataatattactgtggaaccctgctggggcaagaagggaaaaggccccttcttttctctggcccagctggcaggtgctagctatctgcctcccctcaggcccctgcctgccagggatctatacctctctagctgccacagcaacgctttgtcaccctttaggttcttgtgtttgatcgaagtcttttctcctttaatttacatttttaaccaaagtaatatatgtgcacaattgtaaaagttaggatagatacacaaaacttttttttttgttttgttttttttgagatagagtctcactctgtcacccaggctggagtgcagtggtgcgatctcggctcactgcaacttccgcctcccaggttcaagcgactctcctgcctcagcctcccgagtagctgggattacaggcgcccaccaccacgcccggctgatttttgtatttttagtggagatggggtttcaccatgttggccaggctggtctcaaactcctgacctcaagtaatcctgcccaccttggcctcccaaagtgctgggattacaggcgtgagccaccatgcccggcccacaaaacttaaaatgagaaacagcccc

SEQ ID NO: 149 - DNA, 1480 bp, Homo sapiens
tccttcatcttatttaattactcaaaacatcatggcaaatctgttgaaatcaaagtctcattaccttctgcatatctgcttgatcctttttccgagcccacacaactgtgatcacataaaatcctaaaaggctggccagcagtgacaccccaacaggattgttggtcacgcgaaggaacagtttgatcgtgtcttcaacattcacggtcctgggcacgacaaagaagtcgctggcaaagaaggtcaggtggttacagagacactgtgtcctcagaattgtgctctgtggcccaacctggaattagaatcaagacgttgattctagtcagacagagtgctaaggaggggacagacataaaacaaacaccagcaatttagagatggaaagaggtatctggttctctcattcacagctggtgatggcgtaaattggtataaccaatgtggaaagtaatttagcaacatctagtacagctgaagcagaacaaactctttgaatcctgcaattccagttctgagtgtatacatgttctaggggaactgtgcacatgtgtatgaagatatatgaaaaggaatgttttgtcacctttgtctataattatcaaaaataggaaacaacttacatgttcaatagcagaacatacaaatgaacaagtacataagtaagcagaggcaaactgattgaattctatacagcagttaaaaatgaatgaatcagcgggtgtggtggctcatatctgtaatcctagcactttgggaggctgaggcaggtggatcacctgaggctaggagtttgagaccagcctggacaacatggtgaaaccccatctctactaaaaatataaaaattagccaggcttggaggcgcatgcctgtagtcccagctacttgggaggctgaggcaggagaattgcttgaacctgagagacagaggttgcagtgagcccagatcacaccactgcattccaccctgggtgacagagcaagactctgtctccaaaataaataaataatacataaatataaaaattttaaaaaatggatgaattagaggtagatgtatcaacatggataaatgctaagtgaatacaacaagagatatgtacagtataatgccatttgcccaaagcctaagaagcatgcaaaacacttatttatctattcattgtcagtttccctctccagaatgtcagttcatgaggcgattgtcttgttcactgctgtgtctctagttcctagacttgggcatggcacgtagaagacactcaataaatattcggtgaaagaatgaattcccccctcaaattcaggccagtagttaccctttggtggaagggaaggaaggagagagactagagagggatactcagagggcttcaattattcatgagtgttttattatttaagaaaatatgaagcagagcaaaatactaactttgataaagctgaatgtgcattcaatgttttttattattcttta

SEQ ID NO: 150 - DNA, 1150 bp, Homo sapiens
aatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctcttgggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttt

SEQ ID NO: 151 - DNA, 1614 bp, Homo sapiens
gaagccttttaagtgctcttcatgaagttgtcatacagtatgaatacacaataagcgtcattcattaactctacattaatctgacagacattgtacttcacataattactgcctgctgcattacctttgtcctttgtaagctttaatttcacatgtcaacagcaatcactttagagtgttatatttgtagatacagaaaaaggcttgccatggcaaatatgtacttgaaaggtaagccataaactcttgcacttttgtttgcctcccagcttattatagagttttaatttaattttattttttataatttcaacttttagacttgggggtacatgtgctggtttattacatgagtatattgcaggatgctaaggtttgggatacaaaagatcctgtcacccagtgagcatagtacccaacagttagtcaacctttgtccacctctctccctccccactctgggagtccccagtgtctatcattatcaactttatgtccatgaatgcccagtgtttaggtcctacttacaagtgagaacatggagtatttggttttctgttcctgcattgattcgattaggatgatggcctctagctgcatctatgttgctgcaaaggacgtgatttcattcgttttaaggttacattgtattccacggtgtatgtgtaccacattttatttatccagtctaccggtgatggacacctaggttgattccatgcctttgttactgggaatagagctgtgatgaagatacgagtgcatttatctttttggtggaatgatttattttttggggatatatactcagtaatgggattgttgggtcaaatgggagttctgttttaagttctttgagaaatctccaaacagctttccacagtagctgacctaatttacattcccaccaacagtatgtaagcatttctttttctccacagcctcgccagcatctgttgtttttaactttttaataatagccattctgactgttgtgagatggtatctcattgtggttttgattagcatttctctgatgattagtgatgtagaatattttgtcatgtttattggccacttgtatgtcttctttagagaaatatctgttcatgctctttgcccactttttatgggattatgtgttttgtgctttttgaactgtttaaattttttatacattctggttattagacctttgttagatgcatagtttgcaaatattttctcccattctgtaggttgtctgtttgctctattgatagtttcttttgctgtgcaaaagctccttagtttaattaggtattatagggtcctgcaagcttgagttttacttgtataatttttcctgttatattgttgtaaataagactatttgctattttattaatgaaatataaagcactgtgatctgttattaaataagcagattctattagaacttctatatttttcacaataatttcctatcaattccttaggttttaaatgacagccatactatagaactatttattttgcatattgaagatgtaagctaatttgatgccttcagatgcaggcctgagtctgttttcagtggaactctgttttattaaaaatcatattgaataaatc

SEQ ID NO: 152 - DNA, 12575 bp, Homo sapiens
atgacctgcggtgatatatggcaattgttttactgattatgtttagaaaaatccccaacgtgttcaatttcatattaaaatgcctagtatttatggtttataattatcatttttagtgcaatcttgcgcaacaggaatttcattttttataaagttatttgtcacagtgggaggatttgttttctctttagtttatattttataacaattgcaacccatgatttcacagaggagactatgattaggtataatacagattaacctattaagaaatacttgtaaatcttacaattgatcaagattattttgttatgcaaaaaaatagaaaattttattattattgaaagtgctatcatcatacctttaaactttataattgtatgtatttttcctttattcaaggaagattatttaaagtagtgtaacatacctacatactttcaggagctgggcagcgacataagtgaataaatgagtctgttggggaaggtgtaggatgattgcattaacctgcttttagtttgacatagtaacacctacctcattatatttactttcttattctgggggtgtgtttgtttcgatttaatttaattttttgtaatttattgtgactaattgtggggtacagagttatgatatatgtatgcagtgtggaataattaaatcacactaacatatctatcatcttaaatattaattatttaatctctcaattgcaactttccaccctttgataacattatcccatcccaattcccatccccttaccaccaatctaccctctgctactatgagttcaacttttttagattcctcatatcagtgagatgagtggtatttgtctttatgtccttggcttatttcactcaacataatgtcttccaggttcattcatgttgttgcaaattatagaatttccttcttttttcaaggctgagtaatattacattgagcttacaaaccacattttctttatccattcatccactgatggacacaggttgatttcagatagtggcttttgtaaataatgctggagtgaacatgggagtagatatctttttaattcctcatgatatatacaccaaagtgggattgctggatcatatgataattctagtttcagtttttctttctttctctttttttttttttttaggaacttccatacagtttcccataatggccatactattttacactctcaccaacagtgtgcaagggttccctttctttacattgttacacatctgggagacaaacagaacatgtttatggggtgtagtgggcctcagaaagtcaccaactatagcctcctctattacgttactcagtaagatagatgctcccagggagatgttaggtcaatggtatctgccaacttttcattagaaagtattaccctcccctcacaaaggcagtttagaaatacttcatcatggaagtgaaataaaatgctgtcataatttctctactatgacatatctacctcagtctcttcctgttcaatccatatacacattacccttgccccagggttatctttagatacatgagtctttttatgtattctgtaagtagttaatggatttaattcaatgaaatgatatcaccttcaaaagaaaatctaaactcttagactattactaaagcagcctttgggaagaccctccagcatctccctctcattttcatttctccctgtctaccttccttcacgccctaatatatagaaacacatctcattcacttccccactaatgtaaattgagcaccacaaagaagtcaggcactatgctagatacaagtgttaaatatgagtgaacgagaaagacttcatcctactcttggggagcttcacagaggctagtggggttgacagatattaatcaaataattatgatgcatgccgtggaaaagtttaggtaccatggactgtgcatcagttttccaagttgctttttactattttactcatacctgccctttccatctgtgaaaccttcactcaaccctccaatcctcgttgatttacctccttgggacaattattataacttgtatgcatttctcttattcaaaattatcctaatgaaatgggttgcttggttgcttatatgttttcacatgagcaattgctctattttctcttcctttgcagatatagcccttggcgaggtgcctggctccatagtaagtgttcaacaaatgtttgaataaaatattgcattgttgaattttaaatgtatttaagcaaattgataaccaacatctgaccagatttcccaaatttagatgcaatgtcagatgcttcttttaatggtgtcagagattggctgacaggcttgcctgtctttaaagtaatttattacccatgttggttttttggtataaatggttactgtttgtcattggagtatgtttgtattcatggtagagattaaatacatatgtattgcatgaattaacaaatggttatgctagttgtaggaaagattgataagtgaaagtttctaatgctctttttttgagatggagtctcactctgtcacccaggctggagtgcagtggtgctatcttggccaattgcaaccttcgcctcctgggttcaagtgattcttgtgcctcagcctcccaagtagatagaagtacaggtgtgtgccaccatgtccagctaatttttgtagttttagtagagacagggtttcgccatgttggccaggctggtctcaaactcctaatttcaggtgatctgcccatcttagcctcccaaagtctaatgttctttacaggcctatgagtattttatgccagaatattgattttattggagaactaaaaattgatacaatccatagcttgaaagtaaaaatgtcaaaatacttaagaccatacacaaataagtattctaaaataaggaattgatatttataaaatatttttaagaaataaggacatttggccaggcacggtggttcacacctgtaatctcagcactttggaaggctgaggcaggtgcatcataaggtcaggagttcaagacctgcccggccaatgtggtgaaacctcgtccctactaaaaatacaaaaaaacttagccaggcttggtaacaggtgcctgtaaacccagctacctgggaggctgaggcaggagaatcacttgaacctgggaggcagaggttgcagtgagctgagatcatgccactgcactccagcctgggtgacagagcaatttaaaaaaaaagaaataaacacatttaccattacagtattttttagccccccaatcttgttattattaataacaataataaaataataagcccttgacttctttactttgctgtccttttcatttattttgcatttcttcattttccttgtgcagattttatactctgctatcctcagccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacat

SEQ ID NO: 153 - DNA, 11283 bp, Homo sapiens
cctcagaaagtcaccaactatagcctcctctattacgttactcagtaagatagatgctcccagggagatgttaggtcaatggtatctgccaacttttcattagaaagtattaccctcccctcacaaaggcagtttagaaatacttcatcatggaagtgaaataaaatgctgtcataatttctctactatgacatatctacctcagtctcttcctgttcaatccatatacacattacccttgccccagggttatctttagatacatgagtctttttatgtattctgtaagtagttaatggatttaattcaatgaaatgatatcaccttcaaaagaaaatctaaactcttagactattactaaagcagcctttgggaagaccctccagcatctccctctcattttcatttctccctgtctaccttccttcacgccctaatatatagaaacacatctcattcacttccccactaatgtaaattgagcaccacaaagaagtcaggcactatgctagatacaagtgttaaatatgagtgaacgagaaagacttcatcctactcttggggagcttcacagaggctagtggggttgacagatattaatcaaataattatgatgcatgccgtggaaaagtttaggtaccatggactgtgcatcagttttccaagttgctttttactattttactcatacctgccctttccatctgtgaaaccttcactcaaccctccaatcctcgttgatttacctccttgggacaattattataacttgtatgcatttctcttattcaaaattatcctaatgaaatgggttgcttggttgcttatatgttttcacatgagcaattgctctattttctcttcctttgcagatatagcccttggcgaggtgcctggctccatagtaagtgttcaacaaatgtttgaataaaatattgcattgttgaattttaaatgtatttaagcaaattgataaccaacatctgaccagatttcccaaatttagatgcaatgtcagatgcttcttttaatggtgtcagagattggctgacaggcttgcctgtctttaaagtaatttattacccatgttggttttttggtataaatggttactgtttgtcattggagtatgtttgtattcatggtagagattaaatacatatgtattgcatgaattaacaaatggttatgctagttgtaggaaagattgataagtgaaagtttctaatgctctttttttgagatggagtctcactctgtcacccaggctggagtgcagtggtgctatcttggccaattgcaaccttcgcctcctgggttcaagtgattcttgtgcctcagcctcccaagtagatagaagtacaggtgtgtgccaccatgtccagctaatttttgtagttttagtagagacagggtttcgccatgttggccaggctggtctcaaactcctaatttcaggtgatctgcccatcttagcctcccaaagtctaatgttctttacaggcctatgagtattttatgccagaatattgattttattggagaactaaaaattgatacaatccatagcttgaaagtaaaaatgtcaaaatacttaagaccatacacaaataagtattctaaaataaggaattgatatttataaaatatttttaagaaataaggacatttggccaggcacggtggttcacacctgtaatctcagcactttggaaggctgaggcaggtgcatcataaggtcaggagttcaagacctgcccggccaatgtggtgaaacctcgtccctactaaaaatacaaaaaaacttagccaggcttggtaacaggtgcctgtaaacccagctacctgggaggctgaggcaggagaatcacttgaacctgggaggcagaggttgcagtgagctgagatcatgccactgcactccagcctgggtgacagagcaatttaaaaaaaaagaaataaacacatttaccattacagtattttttagccccccaatcttgttattattaataacaataataaaataataagcccttgacttctttactttgctgtccttttcatttattttgcatttcttcattttccttgtgcagattttatactctgctatcctcagccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacat

SEQ ID NO: 154 - DNA, 9163 bp, Homo sapiens
agccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacat

SEQ ID NO: 155 - DNA, 3118 bp, Homo sapiens
aagattggctccaatctcagattttcgctcaaaatgctacaaatgtccatattttagagccctgggtgtgctgtacttgcttttgcaactctggtacatttgtgggtttttttgttttgttttgtttcctcagagtaaaagcactgctgtgtagctcttgtaaaccacagggctgtgaacccacctggccaggaaattgcaggcagcacagttgggagttgaattttcttctcctctgctgccagacagatctctctacagcactcctttaatcatgcatcctcccctgtgatgccagagctcctgggacacagagtgcattgctttacaggctgctttccacagccaaactgggtttgagtggcatagaaggtgtgacattcaaaatcttatgaagaacaaggagaggtagtggggaaagttctagattaggagtctggtgcagctgcagttcaatctgctgctaactctcagacagtcctgtctgctgctggggcagggtatcacctcttttgctggttcaatgcttggcacgtgggctttgctcaataggaaaggtggttatagtgaactgaactaacagtacaaataagaaagccatttaatttctcagtatctcaaacatctatatatacgaagtgggaagaatggctcctgctgtgcttatttcacagggttgttctgaggatctcaactaataataactaccaaaacactttttggtggtatggtgcttatacttgggtaatgtatggttatgtccgttcacttgtcaaacataacagactgttttctttatctcctgaatttttattcaatggaacagtaatgaatccctaaatcttctaaatgtgaacagtaaaagagacagaatgacttttcctggcagtctgcatgccatgactgaattatttagacttctatttaaacctgatgaggaaaaaaaaaaaaccctaagaataaagatttgtcttttaaccaattatttcagaaaaatgtttcttttagacttattcacatttagaagatactattgatagtgtggatgtcctattataaattagataccatttccatatcaaagttaaatatatctgaaaaatgacagagccagcagggattgctagtggtagagtaagttgcaaatgtcagtttattgtagcagtgtaaattatatttaatttaaaagactacgtttaacttttaaaatgagggtactccaagttgaatccatggcaaataaataaatataaaatattttcctaaacatgtcagggtatctcataaagcagtatcctagaggagctctgatttgctggatgctaatagatatatcgtccaaaatatcctaaattcatgtatatgtaagaacatttgagttaaatgcaagtgaatctttttttgcagttttatctgttaagtgtaaatagccaagaaaaggatataatgtagcatttttactaacagttttactgtgataaatttgtttcacgatacctaataacatctcccagccaggcgtggtggctcacacctgtaatcctagcactttgggaggccaaggtgggtggatcacgagttcaggagatcaagaccatcctggctaacacggtgaaaccccatctctactaaaataaataaataaataaataaataaataaataaataaataaaattagccaggcatggtggcacacgcctgtaatcccagctacttgggaggctgtggcaggagaatagcttgaacccgagaggcagaggttgcagtgagctgagatcgcgccactgcactccagcctggcgacagagtgagactgtctcaaaaaaaaaaaaaaaaaaaaaaaaaaaactcccaaaacattgttctgataaacaccattttataaaatgtgttggcaacatgtgtttggttagacttactggagcccaaagttatgccttttggtctgtataaatttaattaacaatagacttattgagcatctattgcataaacaacagtgcgtggggtgctgaagggcataagaaactgagtgaaattatgactgccctttagaagtccaaagtcaaagggcacccatactcagtgtcatggaaatggtataataaagtaggtgcgaggtgggagagtcacatctatttgggtgcagaattgaaagtatcttcccaagagtcaaaagcatgaaataatagaaatccattgtgatcacctttaatagtatgcttacaaagattggtcaaataaatgtagttacatggctggttagtattctggtggatgacactttggaatagcacccgtctccatttgcttcatctcatttgcctcaagttagaataggttcagctcattgacttttttcagttccataagtttatagttatatctgtcacggcatcatggtattgcttattcagttttaaattaaagaagaaacaaaaattggctaaatttttgagagcagttaatacatttttaattaacttactgtgaaaagatacagttagtagcccaacaggatatttttcaattgtttgaacctgaggtttaatatcagagggataattttggagcaaattttactttttttatacttttttcatgctaacttgaaatattgaaacttcagaatgagatgggtctattctctgcttagagagaatcatgacaaaatgcaaatggcccttctcccttcaagtgggggcgtgccaggcatcaattagccacaggtagagttctcttaacctgtggtttgttctcttctgctttatccctatggctggaatggagtgagagtagctagcttctccacgcagatgtgatgtgtagtgcacccaaacataaataagtcttatcaaaagaattcatttaaatggtgcctgtttggttttatcaatcctcactcagaagaacataattctaatagccagataacaacgtggaccagcctggtatataggcatctgtaaaggtacttctgcacaatgactacaaatttaactaggctttttgaaatatgccaaaagcatttattgggagtgattaaacccacatcatttcttgagaacagtttaagagctctgaacgttgatattttgtataaatctctttgtaaat

SEQ ID NO: 156 - DNA, 1824 bp, Homo sapiens
ctcttctccccgaggacgaaatcagatccaagaactaaagttggaagaaatcaggtcaccgggaggaagccacacatctgacgtgcacggctctctgtataacaacagcgtcggcggctactgcctcctttgtaataccagtggagacagaatctgggcaagtgagtccttccccgagggctgtggggcctctgctccccactgtgccaccccagccccggcactgccacagagatctcaggtgagaggccgggctcaggcaacacctggggatcaacctgcatctccagaggccacccaggggtgactctaagcagggaatctgggtcccggtagtgaggaggctcaggcatccctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgaccgtggggaggagcagagccctgcggtctggatgttccccacacaccgcgttcctgaccgtggggaggagcagagccctgcggtctggacgttccccacgcaccgcgttcctgactgtggggaggagcagagccctgcggtctggacgttccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgtggtctggatgttccccacgcactgcgttcctgactgtggggaggagcagagccctgcggtctggatgttccccacgcaccgcgttcctaactgtggggaggagcagagccctgcggtctggatgttccccacgcaccgcgttcctgacactgagtctgcagccccagggctccacgactgcagcctagagtgagtccggccaccacacacactgaggtgggacgcgccctcattcggggggctcagacacagaacaagatgggcgagggccccgttttggccccaaaggcagtcacgccaaagagtttaccaactgtgggaggaggtgtcccaggacttgggacaaggctgtctggacagcgctgtgaatgcaccgaacgcctttattgtttaaaatcgctaatggccaagtctgtgtcatgtgggttctatctcaattttaaaagagaactccgtctcctgagcacggcacacgggcggtcggagggtgagtcgatacttacgttcttcacc

SEQ ID NO: 157 - DNA, 3519 bp, Homo sapiens
ctcttctccccgaggacgaaatcagatccaagaactaaagttggaagaaatcaggtcaccgggaggaagccacacatctgacgtgcacggctctctgtataacaacagcgtcggcggctactgcctcctttgtaataccagtggagacagaatctgggcaagtgagtccttccccgagggctgtggggcctctgctccccactgtgccaccccagccccggcactgccacagagatctcaggtgagaggccgggctcaggcaacacctggggatcaacctgcatctccagaggccacccaggggtgactctaagcagggaatctgggtcccggtagtgaggaggctcaggcatccctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgaccgtggggaggagcagagccctgcggtctggatgttccccacacaccgcgttcctgaccgtggggaggagcagagccctgcggtctggacgttccccacgcaccgcgttcctgactgtggggaggagcagagccctgcggtctggacgttccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgtggtctggatgttccccacgcactgcgttcctgactgtggggaggagcagagccctgcggtctggatgttccccacgcaccgcgttcctaactgtggggaggagcagagccctgcggtctggatgttccccacgcaccgcgttcctgacactgagtctgcagccccagggctccacgactgcagcctagagtgagtccggccaccacacacactgaggtgggacgcgccctcattcggggggctcagacacagaacaagatgggcgagggccccgttttggccccaaaggcagtcacgccaaagagtttaccaactgtgggaggaggtgtcccaggacttgggacaaggctgtctggacagcgctgtgaatgcaccgaacgcctttattgtttaaaatcgctaatggccaagtctgtgtcatgtgggttctatctcaattttaaaagagaactccgtctcctgagcacggcacacgggcggtcggagggtgagtcgatacttacgttcttcaccgcatcagcatatttctgctcattgaagaattcataaaatgtagccatgtaggactccttaaaactcgcctaaaatgaaacggagatcactcgaggacagcccgaagtacctcggctcacggcccaaatctgaaaaagctagaggcaagaactgtccaagcctaaatgacgataaacaggcaaagaacccggtgttaccgggcaagtgagagcccgcagggctgcccggaggacgaatcacataaatcgctcaggcgccaacgaagaccatcagacctgccagtgcccgtgaggtctccaagcaccctttggcatcagtgactccgtcctggccccgggctgtccctcacacctgggtcccaggctcatgaagaggtacgttggggcccagatgtggctgcctgggaacctggagtcataggccagggtcccagagcccccacgcccatctctcgcccgtggggcataagggccgctctgaggtgggaagagggggcagggacctccatcacacggggaagtggaggcacccagggattcgggggggcctttgcagccaccattcctgaggctcgaccccaagttcctgttgtttccacactgaggtcactgcacagttccctggctgtgaaatgaggtgggtttggtgcagacctcggaggaggctcaagtgcctgttatggagtttccagcccacagcgcagggcctggctggtgggaaagagcggtcggtgcacctcggcctgcctgcgagtgtggcacatcttttactcactcggactcagagaaacccaacgtttgccccaagcgggctgctcctccagtgggggcctctgctccccaaagccctcatttctacctgggccccaccaagaacagggaaccaggaggcctgggcatctgtgcaccacagcccagccctctccagacggagccccgagggggcccgaaggcatcgaactgccctggcctggcccctgcagagacagccttgggcctcaccaggagcactgcccccgggacgcctcaaacgtcagctctgaccccctcaaacacacaaggtgctcttagggggaaatggggcagatgcctgagggactcctgacctggtggcaccagatccagtctgaagggacgaggatggaggacggaggttcatatccacagggagagaggggccctgggaggagggggccgcgtggggaggggagcgccacgttgggaggaggcggccgcttggggaggaagcgccacgtggggaggaggcggctgcgtggggagggaagtggggaggagggggctgcatggggaggtagtgcagcatggggaggagggggccatgtgaggaggagggggccgcgtggggaggtggggaggagggggccgcgtggggaggagggggccgcgaggggagtagggggctgcgtgacgaggagcctccagcaccgcaacgcccaggaggcgccaggttaggccatctgcctggcctgttcagccgcttcccacacctgacaggtcagatgctgctcctgccacggggccggcgacgagccacaggctcccgaaaaaggcaaggggttcactttaggaggggagaggtgagcgggacggggacgctcaggtcctgggtttcaagagaggatgtggtgccggctttgattcttgatctttatcttacgactctctcaaatgtggg

SEQ ID NO: 158 - DNA, 4267 bp, Homo sapiens
tctgattgattttctaaagcataagatgtatctcctaagaagtatacaaaagagcgggttaattatgcctaataattaacttgcatactgaaataaaggtagagcatcatttaaattgtaattttctgtatttaggctgtttgtgacattcacatttgattgtaataatacatttttcttgggccaggcgcggtggctcatgcctgtaatcctagcactttgggaggcctgggtgggcagatcatctgaggtcgggagttcgagaccatcctgaccaacatggagaaaacccgtctctactaaaaatgcaaaattagctgggcgttgtggagcatgcctgtagtcccagcaactcgggaggctgaggcaggagaatcacttgaacctgggaggcggaggttgcagtgagccgagatcgtgccactgcactcccgcctgggtgacagagcaaaactccgtctcagaaaacaaaaaacaaaatgatttttctggaatcctaattctcttttgtttcttaggtgttttattgtttactaaagctttaaaaaattacttccttcaaaaacattttttaaaaaggtagttggttgttaaaaatgtcaaattagaagatttttttttttttttttacaaggcctggtaactttatggatatgttcctcttttatgtaactatgtatatcataaagtttattttgcatcctaaacatttctgtatctctttgatgtcttggagaggcaattcagcaaactcgttaagcccagtttcaaatcctggttttatcatttactatctttgtgaccttgagtaagttgcttagtctctctgtagctcaatttcctcttctttaaaatgagaataatattacctcattaaggttgttttgagtaataaattaatacatctaaagcatctaaaaaagtgcctagccactagtaagctataaggattcattattatattattgtagttattattgtctcctgaaatttcaaactctgaaattgaacctattaacttcttaaatctgtaccttctaccatccctgtttttgtcaatggagtaacacccacctaatacctagaattgaaaccttcacaggactgactcattgctttgcttttttacatctggttaatcaaaaattctttttctttgaagtagccctttctatttcttctgtggcctctgccctcatccacgctagatcacttcacatttggattattactgcagcctacttgacaccattatgttttatgtttaacttccctaagtcataccacataatgctgctaagctaattttcctgagaaatccaaccatgaaagttccttatgagaacttttcggtggctaccatttctttctgagccatcagtaaacccctctctaggacttctaactcctttttttttttccttttctttttttttttttttttttttttgagacaaagtcttgctctgtcacccaggctggagtacagtggtgcaatctcaactccctgcaacctttgcctcccgggttcaagcaattcttgtgcctcagcctcccaagtagctgggattacaggcatgtatcactatacccagctaatctttttgtattttgggtagagatggggttttgttatgttggctagctgtcaaactcctggccttaagtgatctggctgctttggccttgcaaagcgctgggattacaggtgtgagccaccacgcctggactttttttttttttttttttgagacagagtctcaactctgttccccaggctgaagtgtggtggtgccatcttggctcactgcagccttgatcttccaggctaagtgatcctcccacctcagcctcccaaatagctggggccacaggcatgtgccaccacacccggctaatttttgaaatttttttgtagagacggagtctcactatgttgctcaggctggtctcaaatttctgggctcaagtttctcccacctgagcgtcccaaagggttgggattacaggcgtgagccactgttcctggcctttaactctttcaatagtctacctcttccttcttggcaatctttgtccactattcctcaacatgcatcttctctggtaatgccaattataccctttctgtgcccccgtcatggctcaactttcccccccaatcttctttcctactaatatactctgtcttcacctctttctaggcccaaattctaagtatacttggaagacatgattgctgttttctatctgtctgtctgtctgtctgtctgtctgtctgtctgtctatctgtctgtctatctagagtctcactttgtcgcccaggctggagtgcagtggtgagatctcagcttattgcaacctctgcctcccgggttcaagtgattcttgtgcctcagcttcccaagtagctgggattacagtcgcccaccaccacacctggctaatttttgtatttttagtagagatggggttttgccatgttggctaggctggtctcgaactcctgacctcaggtgatccgcctgccttggcctctcagagtgctgggattacgggcatgaacccctgtgcccggccttttgctctgttttaaactcttacaataccaaaaagcatttgttacataatgacatatacttatatataggcctactgtttgattttttttaatatatgtaaatcttacattcaactgagcttctacagaacggaaatcacatttgatacttaagtaattgtttttcctgtttcatacttagtatctcgctgtattctgattgctatagcgtcttttcatagaacatgtttgttgctcattttttaattatgggaaatctcaaatatatataaaagtaaagaggacagtatatggaactccggagtacccagtataatgaagttctttgtgcttatccctcagtttcaacctttatcaatttatagcggagcctcttttatctatttccccccgaatcagctcttaatattgtttgccttttggacttgtaaatatgaaaaagtggactattccagagtgtgttgcagatggcatatttttatactgttaaatttggtattatgactcatgataaaaattccatcttgtttttaatttaaaaaaaatctggcaattaccatttatttttatattgttaaatttaacattgtgactcactctataaatattccatttggttttaatttttaaaactctggcagttaccatttatttcagtgacttagcttaataaataaattaatttggcaaatatttattgaatgcctactatgtgccaggcatcgtgccagacactagggagccaaggtgaataagatattagatctcatgttttttgaagtccatttttctgttttatttaaaagtaagactattttgtagtatatgagtaaaggccttttagaactgtatttccaaattattattattttttgagacagtcttactctgttgcccaggctagagtgcagtggcgcaacctccacctcccaggtttaagcttgtgcctcagcctcaagtagctgggactacagtcgtgggccccaaggcccacctaatttttgtatttttggtacagatggggtttcgccatgctggccaggcaggtctcaaactcttggcctcaagttatccgcccgcctcggcttcccaaagtgctgggattacaagtgtgagccactgtgaccggcctctaaactcattttttaaagactggtaacgtttctaagaaaattcttgggacctgtacagttagcagcttgttattttgccaggttaaggtctgtatatgaaaatatctaatactttaattttaaaaatatgtttttaaactgaagaaaggacataatctcagaataaaagataatctttttaaaaatttatttaaaagttttaaaatttttagtaggcacaggttcttgctttgttgcccaggctggtctcaaactgtgggctcaagtgttactcctgcctcagcttcccgaagtgctgggatcacgggtgtgagccatcacacacggcctcaaggacaatcttttaattaaaaaaaaaatcttttgtatgtagaggcagggtcttgctgtcttacccaggctgggtgctcaagcagttgtgccttggcctcccaaagtgggtaggattgtaggcatgagccaccatgcctgacttaatcttttaatatttgattttatgaaatagcactacatatcccccccgttttgttgtagaccaataaaaggtgataa

SEQ ID NO: 159 - DNA, 17531 bp, Homo sapiens
tgttcagggtctaaatctcatgatgttcaagaagtgcttaaaaaaaaacaggtaacagtcttgattcttcttgccttacagaagaaaagatgccttgaatttttaagtggttacattatcacttttaaatcagttcatgttggcagggcataacatcataatgcttatttagcttcttctctaatgtaaacttggaaaaaaaaggtggacatacagaaaaaatgtttcacaattgccattcagaatttttttttgatacactattattccctccaattctagtgtttattttctttttttaattcctaggtagataatgattcatataaaatataagacttttgtaattattatctatatgattcagttctgagtttcattgtcatcctgttaagttcacatagggttttccaaattaaatagatatttatatgtactatctcagtataattagagatttaacaggagggtgggaggcaaaattttcctggtgaaatccatagattttactctcttatttcttatttcttttttttttttttgagacggagttttgctcttgttgcccaggctggagtgcaatggtgtggtcttggctcactgcaacctccgcctcctgggttcaagcgattctcctgcctcagcctccagagtagctgggattacaggcatgcgccaccacccctggctaattttgtatttttagtagagatggattttctccatgttggtcaggctagtcttgaactcccaacctcaggtgatccacctgcctcggcttcccaaagtgctgggattacaggtgtgagccactatgcccggcctactctatcatttctaacctatagctgcatgtcacttttttcttttcttttcttttctttgagacaagttctcactctgtcactcacgttgagtgcagtgtcatgatcatggcccagtgcagccttgatgtcccaggctcaaatgatcctcccaccttagccttctgagtagctgagtaggcatgtgccaccatgccctggctaattttgttcatttttttgtagagacagggtctcattctgttgccgaggctggactcaagcattcctaccacctcagcctcccaaaatgctaggattacaagttgagccaccatgcctagcctcacatttttaaactttaaacttaaaaaataaggatttagctattacattggcaagtgaaaacaactttggtttttcttcataaggacattcaggtcattcaagtcaataaatctcatagatatagctaattaggtccaatattttaaatattttttaagtacagttgtaaactctattatgctgaaagtgttagggaaaatatattcaaaggtttcatctatggtgtcagctatttttttattaggaggacagtctgtctcagggatgacccagaaaaaatgagttgagaatggtggcaaattacattatctgtattaatttcttttttacttatacaggaagcaatgaagttacaacaagatatgaggaaaaaaagacaggaagtgttagaaaagcaaatagaatgccaaaaggtaagacaagagctcattatttgcatgctagaattgatgtatagaattgattttaaaagtattattcataatttttaaagacttctttatattaaagtttattaagcatggttttacctttttctatttatttcgtagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggtatctatttgcattttttatttaacatagggttattgaacatctgccatgtgcttgacaccttgaaagtacaatgggacccttaggtagctaatatcctaacagggatataggcaaacaattatagtacttaaaaaaaaaatcctaattatagtaccttttttttttttttttttttttttaagagacaaggtctcactatattgcccaggttggcctcaaatgcagtcctcccaccttggcctcccagagtgctgggattacaggtgtgaaccactgcacccggctgccacaatttttttgttttagtgtttctgtagatgctctgtaccctttttgggaagaggttgataataccctgtttgaacaaagatgtgttttttaactgaatattttggttctctgctgaagatgacactattaaagtgatggtggtgaaagaggtatttcccatttcagcagtgtttttctaatgctgtaatagtattgtaataaaaccatcctttaaaaaaagaagcctggcctattcatatgggtaaaaatgtggcatgttattaaaaagaataatcagaagttttagatctatttaagtctaatttttattaatttccatgtgtttccttgctgtacttggtttagtcagtggttccattacaccacagttctgtggtgtgattatagataattctagtcctttgagaactggtaatgaatttgtcagatatgtagaatgtaaattgttatatgtagtattacattaaatttgaaattatggttctctatcagtatagaaacataaagtgtttaagatttcttcttaaagatataataaaaatgttttttattgaaatcttttctaattatagaaagaatatatatgcacattttaaaaattaaagaggtgaaaaaatcattggcagtcatgtcttttaaagactgataaataattcgtctctaacaaaaaagagaatgtcaacagttgtggattccaatctggtagtaattatgtagctgttactttgtattataaatacatttttactatataatttattttgctccattgtgtttcatttgtgatactttattatgtgacagttattctcagctccctcatctcaggtgtctgttcctaggatgtaatttttaagccgtctaatgcttactctttttcactgatatctatatactttttacatgttggcactactatatctgtaaagttacttttttaaaaacacccatgtttattgcatcctctcattctcatgttccaaaatacatgtgtgtcattgtgtaactatcatgttctggaggagatcttgtaagttatctaaaaaatacctttttattttcaatttttccaaaggcccagaaggagttattagatactgaactggacctccacaagaggctgtcctcaggagaagacaccacagaattacggaaaaaactcagtcagttacaggttgaggtgagatttaaaaggagttagcgccccaccacatttaacgtctcaaaaaagttttcctttgaccgggcgcggtggctcacgcctgtaatctcagcactttgggaggccgaggcgggtggatcacctgaggtcaagagtttgagacaagcctgaccaacatggagaaaccccgtctctactaaaaatacaaaattagccaggcatggtggtgcttgcctgtaatcccagctgcttgggaggctgaggcaggagaatagcttgaacctgggaggcagaggttgcagtgagccgagatcgtgccattgcactcgagcctaggcaacgagagtgaaattccatctcaaaaaaaaaaaaaaagttttcctttgtttttaaggtttagtctaataatgtatgctacattctactttttgttgttattcaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcagtaagtttttaaaatagcaaatgctaactgtaaaaacactgtgctcatcattttccttgctgcagtgtctataaatgtcagatgttttatagattagaaaaattagttgtaaaaaacatgagtactaccaaatgcctatttaatatatttaaaagtcaagaagcagctcttgcttttgattccataatactccacttaagtgcatttgtagtgacaagttgttccagagctatatttaatttttgttttaggattattacatggcttaccaggcatttatagttaatagtgaaacagtctgggatggaagcaaaattcaaataaagaatttattaggataacaggtatatttagttacattctgtatatagtggcaaccacttacttttaggcaaacatgcaaatagagatttgctacaggcaaatgtctttactgttttggacatatgcagtatatactctttccagccactcattcattcagtaaatattttattgacattatttgtgctagaacattttcatacatgatctcatttaattttaaatgactgtataaatgtgaaatacatgcaaactgtatatacatgcaaaactgtgtacatgtgaaatcctgtgtgtacagatgtgaacaccacaagttaaaatgtcaaccacaatcatataattaataagtagtggaaccaagataaccaggttccctattcctcaaacaactcttttgagaggaagtattttcagtcctattaagttttaaagatggccagggacaatggctcatgtctgtaatcccagcactctgggaggctgaggcaggtggatgacctgaggtcagtcaggagtttgagaccagcctggccaacatggtgaaaccccatctctactaaaaatacaaaaattagctgggtgtggtggtgtgcgcctgtaatcccagcttcttaggaagctgaggcaggagaattgcttgaactcgggaggcagaggttgcagtgagctgagatagtgccattgcacaccagcctgggccacaagagcgaaactccatctcaaaaaaaaaaaaaaagtattaaagatggtgagggaaatcataaagagcaaggcttcacttcaagtgtttttattagtttgatgcccattaaccctgtttcaccctgattcttggggaagataggccaagaaaagtgtccagatttgaatgtcctctgggttgtgaatggttcactcttgacccagttctttccctgatgtaacccttatttgccttttttgtaaagtgggagaatagctctaagtgacttcttgaggagtaaagaagatggaggaacactatacaagtgcagtgtattgtgaaggccgcacgaatgttgatttttgccttttaaggtttagtatataaaattaaaatctctttgccaaataaattggtcttgtagaaccagtaccagttctggtgaggtgatattggattatgtgaagcagaatttctacaaatttgactcattgcagaaagtttcagttacaaaaaatagttaatcttactagggagacagctacatgttctatcctgtggtcactggagactatatgtagatgtttaaattttaacccagaagccatgctcaaatggatctccttccttctgaaaagtagaaccattctaaagcatctaaaaataaccaatttttatgtacatatacctgacaagtctgcagtgtggcattcagttggcagatgtggttatgtctagacacttagaaaagagcaagcaaagctaaggcagatgaggtaacttcaagaacaaaacacttcctttgatttggatggctctttttttttcttttttgatagcatactatcagaaagggtattgagtactaggagcacacttccctgataataactacctgggcaatatagtatgctttctttgaaagaaatacagaaatacatattcttaggcattattgcgaatagagttagcaaacataaaaggaaactcttcttcaaggtcttttgtatctcacagaggccaaggtaaaatctatattttcagtattcttctattcttaatgattatgaaaggatcatgggtgagccatatctatatgagaaaatgatggatggattttaatgaagctatttggaatctaattctggagtccttcagagtttgctcttcaatagtctaagaacttatcataagtggattatggtcgtatgcaaatggcagctataagtatgctcattatagtgcatgtaatagtgaaaaatgataaccatgtaaatgtttgacagtgttttgctgcctttaaaaatgtattttttttgagacggagttttgctctcgtcgcccaggctggagtgcaatggcacgatcttggctcattgcaacctccacctcctgggttcaagcgattatcctgcctcagcctcctgagtagctgggattacaggtgttagccaccacacccagctaatttttgtatttttagtgttagtagtattagcatttctctattttccatacttcctgaggaacacatactcctttttttttttaataggtggttatcttttttttgttttttgttttctgttttttgtgacagtctccatctgtcacccaggctggagtgtagtggcatgatcttagctcactacaacctctgcctcctgggttcaagcgattctcgtgcctcagcctcctgagtagctgagactacaggcacgcacgaccacacccagctaatttttctgtattttttactagagatggggttttgccatgttggccaggctggtctcaaactcctggcctccagtgataactgcccgccggccgcgttggcctcccaaagtgctgggattacaggcatgagccaccgtgcccggcccacacatactacttttaaaatcagacttttttcttcacattcacttttgggatgaagcatcagtgttttatattatgtattttaaaaccaaatttgaggatattgattgatctcgatctttttggtcccaggtacttatatgaaaggtatatttacattaaagcatatacaaatttaaaatacatagaatatttaatttacagtgcaggttatatatataacagcataaaaacatacattaatatataaatatattaatagtatgtatcagagatcagcagactttttctgtaaaggactagatagtaaatactttaggttttttgtgaggagatacagatgatctcctttacattgtcttctctcctttcacctgctcttccctctcttcctctttcctttctagttctttttcttttttttctttttcttctttgtacttcaatggatgaacatatttttcttttaataaccttttcaaaaatgtaaaaaccattcttagctcctgggtcgttaaaaacagggtgctgggctacatttatcctgagggctgtagtatgcagacccctggtatgttattatgttactttatatatcaaatatttaagttaaacataattgaaatatataaatataattttatatattttaaagatcaaaatcagcgaatccagaaagaactttttaattttaatttttttttattttttatttttttggagacggagtcttgctctgtcgcccaggctggagtgcagtggtgtgatctcgactcccttgcaatctccgcctcctaggttcaagtgattcacctacctcagtccctccagtagttgggattacaggcgtacacctcctggctaatttttttgtgttttttagtagagacgggtttcaccatgttggccagcctggtctcaaactcctgacctcaggtgatccactgccttagcctcccaaagtgctaggattataggcatgagccactgcgcccggcccagaaagaactttttaaaaaatagaaaaatctttatttacctatctttatttcacagaaatcttaagatttttaatatcttaatgaagttaatgttaagtatttataattaaagtttaattcagaagctgaaaattttaactcagagccttgccaagggcacagatgggacaaaaactaaagtacttcatccctgttgaagggaggttcggctagatacaacaggaaaagttattttctctaaatatttggaatatatagactgtactttgatatttttcaagtagtgtggctcatttaactgtaagaattttgaatttttccttcttttcaagaagtctagagttaggttttaggattgatcaattcagaaattcagctgctcagattaatatatttctcttcttctatcctaccatgttgccttttattaggcttttttcctcttgccttgacctcccaaaatgttgggattacaggcatgagccattgcacctggctagtttttttttctttttttaaattcctgtttttactgttacttcttgatttctaaattgtaagcattatatattgacttcccattaatctttctgcttcccacctctccagtttttttttgaccttgtcgtgttttcttttatttttttgttacggatttataccttaaaaaaataaattattctactgtcatttcagtgggtgtctggggaagggtatgaaattgcatacgacagatggtcagttccccatctttagccagaagaccctttgagtcttgagaaagtaagaggtttatctctaaagtactgtttagaacctgtgctcccacaatatttatataattcgttataatttttatgttcttactggcaaaaacctctaatgtctcactcctgtcattcctggaacttcatatgaggcaacagaatacctctgctgtaattaccaaagacttcgcacatagttagcttttccccacagcctctcaagacagggattttcccccatcttccaagtatctgaaaaatatatttgagaattttactgtacatggaaatgatactttatagttaggcagatagttttcttttgtgctttccagaacaaaaattaaccttttctgtgtatttaacatttggagaaagttttttagatagtgcttcattgattgcccttcatcagaccttgttaaaaaagtaatgtaggcctggcttggtggcacctgcctgtaatcccagcactttgggaggctgaggtgggaggattgcttgagcccagaagttcaagaccaacctgggcagcatagtgagaccctatctttacaaaacaacttaaattaaatttaaaaggtaatatgggtgatttgtgagctatgaccatttactgttgttatctgtcacaagtgatcaggagtttaccttttctgcacactttactgtgttcagggttcttcaggtgaaaatataattttcgtagctagttctaggagtgaaatatggcaatggtaattctgtgacctttacaaagacattgaaactctaaactgctgtaattttttctcttaattttgaaaatttctttacaaaggtagttactgcttttagaacattcaaacaatacaaattataaaggagaaggcacaacaaatttgaaatcttaccaattacatttttatgaacatctttctagcacctgtatctgtcatatgtatacatactacccatgctgttttggagtttgtttttacatccatagtgtatcatggagaattgttcatgtttatgaatatagatatacatttgtcttatttgaaggcattctgttataagaatatgccataatttttatgtacagccccctattgatgagttaggtaggttgtttaccatttaactattatgaacaatgttatatacatcatgttagatttagcatatttactgggataatttttttttttttttttttttttgagacggagtcttgctgtgtcacccaggctggagtgcagtggcacgatcttggctccctgcaacctccacctcctgggttcatgccattctcctgcctcagccacccgagcagctgggaccacaggcgcccgccaccaggcccagctaattttttttttttttttgtatttttagtagaggcggggtttcaccatgttggtcaggctggtctcaaactcctgatctcaggtgacctcccacctcggcctcccaaagtgctgggattacaggcatgagccaccgcgcctggccaataatttttcattatgtgggacagtgctgcacattgtaaaacttctggcacccctggctaccacctactaattgccagtaagtgctacttagtcagtgtgactgccaaaatacctgctagagtgatgtctccaattgagaaccactgctttaggtaaattcctaggaaggagataactggatcaaaggcatgcattgaaattttggtacagctcgctaaataacccttcagaatgttgtactaatttatacttgtagtgacattggatgagagtacctatttgctcattccctcatatagcacttgaattttgtttttttatctgccagtcagttgattgatacatgatgactggcatagattgggcgtcagtttctaatcggggaaaatggctggactagatgaatttctctttgagcagcttctaccaagaaccctaatatgcatataatttttaatttatggtatatatagttgatctcatattcacatatatatgtattttatttgaattatttccttggccaacacacgtaaacaaaatgaaaaaggaataaaagtgtatacaatgaaaaataagatttccttctacctccagtcactcaatttcactccccatagacaattattgttacgagtttctcatacatctgcttaaagatattctctctctatatatattatttgttctctcttttataaaaatggtagcatgttatacaacaccgttttgccatatgtacttttactttatattagattttaaattgttctacactagtgcatgtggtgttgcttcattctttttaatgactgcatggtatttcattgcacagatatataatactacagttgaaccatcctgtattgatggacatccaattttttcccaatttttttttttttttgagacggagtctggctgcctcccaggctggagtgcagtgatgcagtctgagctcactgcatgctccgcctcgcaggttcatgccattctcctgcctcagcctcccgagtagctgggactacaggcactcgccaccacgcctggctaattttttgtattttgagtagagacggggtttcaccgtgttagccaggatggtctcgatctcctgacctcgtgatctgcccgcctctgcctcccaaagtgctgggattacaggcatcagcccctgcgcctggccttttttcccaatattttatcattttaaaccatatttagatgtgtatgtgagagaatgtatatgtatgtgtagaacaattaggtactgtaataagtaacaaatatgttaagagattaatcctagatttttttaaaaagtactttttagggctgggtgcggtggctcacacctgtaatcccagcactttgggagccccaggtgggtggatcacgaggtcaggagattgagaccatcctggctgacacagtgaaaccccatctctactaagaatacagaaaattagccgggcatggtggcgtgcacctggagtcccagctactcaggaggctgaggcaggagaatcacttaaacctgggaggcgggttacagtgagccgagatcgcgccactgcactccagcctgggcgacagagtgagactctgtctaaaaaacaaaaaaacaaaaaaaaaacaaaacttttaaaaataaaaatataatgtatgcaaatggttaaaaggatgactagggccaggtacggtggctcacgcctataatcacagcactttgggaggccgaggcgggtggatcacctgacctcaggagtttgagaccagcctggccaacatggcaaaaccctatctcaacaaaaaatacaaaaattagctagctgtggtggcatctgcctgtagtcgcagctactcgggagcctgaggcacatgaattgcttgagcccaggaggtggaggttggagtgaacccagattgcgccactgcactccagcctgggcaatagagcaagactctgtctcaaaaaaaaaaaaaaaaaaagtatgactaataaaagtaaaatctcccttttattaatctttttccattcttaaaagatagtcactattcttaggtatctttatagaaaaatactatgtatgtaagaaaacatatataaagcttctcactttaaaaacatttacgaaaatgtgatcgtattatacatacagggctgcattccaaaccttgcctttttcacataaaaatcttagctatctggtattcctttaattttttttttttttggagacagagtctcaagtcacctgtcacccaggccggagtgcagtggtacgatctcagctcactgcaacctccacctcccaggttcagggattctcctttcttcgcctcctgagtagctgggattataggcatgcaccaccgcgcccagctaatttttgtatttttagtagagatgaggtttcaccatgttggccagctggtctcaaactcctgaactcaggtgatctacctgcctcagcctcaaagggctgggattataggcatgtgccaccacgcccgacctatttccttaaaatttttaaaggttatacctatagtcaactaaaaatgtttataaaaaccaactatactgatcataaacatatagttcaatgatttatgagaaggcaaacacctaatatacctatacctcaggtcaagaaatagaacatttccaataccccaatctcccttgttgctccctccagcctctatctatcttctctccttctcagagcagtaactgttagcctcactttatgatagtcaccttgctttctttatacagtcaatccttattattttcagattccacatttgccaattcatctactcactaaaatttatttgtaaccccaaaatcaatacttatggtgttttgtggtcattctcagacatacacacagttgccagtcccctcatgagcccgttttcagctgagatagaaataaggtggtgctatgccttcttgtttcagcttttatactgtaaacaaatgccccttttgcagtctatttgttttatttatttatttatttatttttgagacagagtctcgctctgtcactcaggctggagtgcagtggcatgatcttggctcactgcagccttcgcctcccgggttcaagtgattatcttgcctcagcctacctagtagctgggattacaggcgcccaccaccacacccaactaatttttgtatttttagtagtagagacgaggtttcaccatgttggccaggttggtctcaaactcctgacatcggcctcctaaagtgctaggatgacaggcgtgagcccctgcgcccagcctttgcagtctatttaatgccacatttttctcaattttttttgttttcttggtgattaaactgttttaaatggcccccgaatgtagttctaaagtcctgtctagtgttcctaagtgcaaggctgtgatatgccttacaaagatacatgtgttagttaagctttgttcaggcatgagtgagtgcttttggccatgagttcaatgttaatgaatcagtaacatatattaaataagatgtctttcaacagaaacacataaaaccaaagtttgtgttgattagctgacaaaaatgttgtgaccctctaaaacaggagtgtccaatcttttggcttccctggaccacactggaagaagaataattgtcttgggccacacataaaatacactaacactaatgatacctgatgaacaggaaaaaaaaatctcatagtgttttaagaaagtttatgaaatttgtgttgggctgcattcaaagccatcctgggccatatgtggcccatgggccacaggttggacaaggttgctctagaggctcataagagtctaattctatttcccctataagtagtggctatttgccagttaaatgtttgcatcaactttttagaacaaaactactgcaagtaatgagaattgactgtagttttatcacctaaatatgcattcctaaatattagagtagtattctgcctgtttttaaaatgttatgtaaatggaatcacacagtgtatattcttttgtgcttggcttcttctgtttaatgtttgtgagactcattcatgtttttacatgtaacattaatttgccatttttattactatataatagttgtatcaatataccacagtttatttttcatctttttttttttttttttttttgagatggagtctcactctgttgcccaggccagatcacagtggcgcgatctcggctcttggcaacctccacctcatgggttcaagcgattctctcctgcctcagcctcctgagtagctgggattatgggcgtgtgccagtacccctggctaatttttgtatttttagtagagatggtgtttctccatgttggacaggctggtcttgaactgctgacctcaggtgatccgcccacctcggcctcccaaagtgttaggattacaggcgtgagccaccgcacccagcctcatcctcttactgatggatgtttgggttatttctactatgtggcttttgtaagcagtgttgctatcttatacatgtttttaactacacatgtacacaccatttctcttggatatacagttggcccttcatatgtgtgggtttcacctccatggattcaacctattttggatcaaaaatattgggaaaaaaatgaaaggttgcatctgtactgagcatgtacattttttgtcattattccctaaacaatacagtataacaactatttacatagcttttacattgcattagatattataagtaatctagagaggattcaaagtatataggagaatgtgtgtagattacatgctaatactacactattttatgtaaatgacttgagcattcatggattttggtattcacagagagtcctggaaccagtcccccagaaacaccaagtgatgactgtatgtggaattgctgagtgaaccccatcagttttagattcttaccagtttagaatcagtttgagattctcaccatttgtgtatgagaattcctaacttggtagcgtcataatatatctttattctaattgctaatttatttgatttgttgtaagttagatagtagaaattatttgttcttaatttcagactctgtatacatttcttattcttcctttaataatgtatatgcaatacatttaatgccttaatattccttttggaggacagacctcttatcctctttggagagcaacacagttattacagatttaaaaatctttattactttttctgtttataaaagtaatatgtttttatttagaaattcaaataataaagaaatgaacaaaacaagcagggaaagcctctctataattgggctgtgtgttaaaggatagagtaaagggtaaaggatctctgttacgtacattacctaatttttaaaagatggtaaatatagaccaggtgctgtggctcgtgcctgtaattccaacactttgggaggctaaggtgggagaattcctcgagcccaagagtttgagaccagcctgggcaacatcgggagaccccgtctataaaaataaaaaaattagccaggtgaggtggtgcatgcctgtggtctcagctccttgggaagctgaagtgggaggatcacttggacccagggagtcgaggctgcagtgagtgtgatcttcccactgcacattccagcctgggaatcagagcaagaccctgtctcaaaaagaaaaaaaaaaggtacatatctatatttggtagggctattttgatacatcagtttggtatgtcccatgagtcataatgtttggtgttaggttatgagcatttagacccttcaaggaatggtgggaatttttcccttagaacacaggacgatgtctgtgcaggcagtaatggatttatgagtctgctctaatgtacattctcaccatgctatgctccaagtgttttatggaaacatttggcaaatgcttcaggaggtttagcaatgattttgctagatagactagaatgaaagcccaaataaaaaagaatctcttctattatgttttttagaacccccagttctataaatgaggacctttgataggaaagctatagggatggctaaacttctacttttctgaaactttggatccctagtcccttgtctgtgttgctttgtctttaaaatttgctttcccctattggaatttgctggggagaaaaaaatgtttaaaaattagtaccaagtaacatttgaaatggagcagttttatgagttaggatagtattaggcatttgtttaatgtttattgaatgcatagatgagctgggaggtgcttattagtgtatagcgtttcagaagtggaaataagaagaactttatccaacataggtggggctgtgagagatgcagtgagatgaataagcagatgattcaccttttttctaaggtttgagtctatatatgtagatatcaaagccaaaggtcaatacctgtattaagaatatttcttgtcctcatcatgacttttgtaagtagagcaactctacttagaaaaaaaattatttcttcaaccaagacagatgctaacatttacctgacacagatataaaccatgggttatcctaggcaaaccagaacatatagttgctctaattaaaagggactttattttttttagctctcattggagattgtagatccaccttaacagatttctctcctgccctatgttatactttttaaataacacagaatttgcagaaatcattagtaaatttgagtgcaaacttgtatgttcttctaatatatattttagaccgcaaaccaagggccaaaatttaaagaccgtcggctacagatatcatggcacaagcccaaggtaccatctatatccactgagactgaagaagaagaagtcaaggaggaggtaaatttagtggttggaaataagagttgaattagatcacttctcaattatgtattttttatgatattaaatagtataaattaaaaaatgctgggtttttctttcatgcatgcaaattaagacccgtttagatgtttattagagaattaaaacaggtctagagatataagaagctgtgttaggggttattttcttctgatataggaaagactgttcttttttgtttacatttatattggatttatttgagctctagaaatttttattctgatgaataaagtcagagattacataaatgaattaaactttaattggttggtttcactttttgtttattcaagttccatagtaatagatttgagtttcttattttccttctgtgtacaattggttaaaatcagagtgtgcagaagttgaacatagaggagagaattggaaaactaaagacctaaataataaaagtactgaataatcagcttcttaaaatatatgagaatttattttgcttttttactc

SEQ ID NO: 160 - DNA, 1194 bp, Homo sapiens
tgttcagggtctaaatctcatgatgttcaagaagtgcttaaaaaaaaacaggtaacagtcttgattcttcttgccttacagaagaaaagatgccttgaatttttaagtggttacattatcacttttaaatcagttcatgttggcagggcataacatcataatgcttatttagcttcttctctaatgtaaacttggaaaaaaaaggtggacatacagaaaaaatgtttcacaattgccattcagaatttttttttgatacactattattccctccaattctagtgtttattttctttttttaattcctaggtagataatgattcatataaaatataagacttttgtaattattatctatatgattcagttctgagtttcattgtcatcctgttaagttcacatagggttttccaaattaaatagatatttatatgtactatctcagtataattagagatttaacaggagggtgggaggcaaaattttcctggtgaaatccatagattttactctcttatttcttatttcttttttttttttttgagacggagttttgctcttgttgcccaggctggagtgcaatggtgtggtcttggctcactgcaacctccgcctcctgggttcaagcgattctcctgcctcagcctccagagtagctgggattacaggcatgcgccaccacccctggctaattttgtatttttagtagagatggattttctccatgttggtcaggctagtcttgaactcccaacctcaggtgatccacctgcctcggcttcccaaagtgctgggattacaggtgtgagccactatgcccggcctactctatcatttctaacctatagctgcatgtcacttttttcttttcttttcttttctttgagacaagttctcactctgtcactcacgttgagtgcagtgtcatgatcatggcccagtgcagccttgatgtcccaggctcaaatgatcctcccaccttagccttctgagtagctgagtaggcatgtgccaccatgccctggctaattttgttcatttttttgtagagacagggtctcattctgttgccgaggctggactcaagcattcctaccacctcagcctcccaaaatgctaggattacaagttgagccaccatgcctagcctcacatttttaaactttaaacttaaaaaataaggatttagctatt

SEQ ID NO: 161 - DNA, 6798 bp, Homo sapiens
acagtctgtattttagagatctcttgattgacttttcaaacactatcactgccattcacaaaaggggatttttgattcttcttaaatagcttttctacctttttttgaaaattgaaagttgctgaaactagaagaacaaaattccactacccagaattattggtattggcttttaactttttatttagacataatttcagatttacaaaaaaagttgcaagaatagtacaaaagaaatctcagctatctttcaccagattcctcaaatgttaacattttgccaatttgctttatccttctcttcataggtttcttctgaaatgttttgctagtaagttgcagatgtgatgccccttaacccataaatacttaagtgtattttctaaaaattaggactagtcttacctaacaacagtacgacaatcaaaatcaggaaactaacactgataaaatacctaatctacagttcttaaatagattttgccgatttttctgagttggtgtacttttttttttttttcctttttggagatggagtctcgctctgtcacccaggctggagtgtagtggcgcgatctcacctcactgtaacctccgcctcccgggttcaagcaattctcttgcctcatcctccatagaagctggaattataggtgcctgccaccatgcctggctaatttttgtatttttagtagagacggggtttgaccatgttgtccaggctggtcttggaacttctgacctcaggtgatccacccgccttggcctcccaaagtgttgggattgcgtgagccaccgcacttggccaatatgccttttttaaaatggcagctatatgaactatattgacatagaaaattcacctgtaagtgcacaattcaatgatttttggtaaatatacaaagttatgcatccattaccccaaaaggattccttctgtctgtttgcaagtcaccctgttccaccccagtttcaggcaagccctcatttttctgtatagatagtagtagatagcgctgcttttttgttttatttggtttttgagatggggtctctttcacccaggtggagggcagtgctgcgatcttggctcactgcaacttccgcatttcaggcttaagcaatcctcccaccccagcctcccaagtagctgggaccacaggtgcacgccaccatgcctggctatttttttgtatttttggtagagatggggtttcaccatgttgcccaggcgggtctggaactcaggctcaaaggatccacctgcctcgtcctcccaaagtgctgggattacaggtatgagccactgtgcccagccttgtttttgtttttaaaaagatgaattcttcctgtgttgctcaggctggagtgcagtggctattcacaggcgtaatcccactattgatcagtttgggagttttgcccttctctgttggcaacctggtggttctctctcatcccaggaggtcaccatattaatgctgaatggacttagcatgaacacctgatcagtagcgtgctgcagcccagaactccagggctcaagtgatcctcctgcgtagctgtgactataggcaggcacaggagtgttgctctttaatcattgaaaatggtaaaacaacaaaagtggcaatgtcagaaaaagatcaactcttttttggagatttccaaacaattgagtattttcatacttctgaaaagctttgctgtaaaagtagtttttctgttaagcatttcccattcttctttgggcataaaacacttttttttttctaggaataattcctgcagacctgacacataattggaagtagatattgaatgaatgagtgagttgtatgtgaatatttgctcagaggaatctcagttcattatcatttcagaaatttggcacgtagtgtactgatggagctagtctaaaataatctatcctgggagaaataattttgtttctatctggataagtctacaatagaggaatgcttattagcagtgttttgctgtattttgcatacttgcagtattcttaagagtgcagaaaaaaatagtttgaaagattcaaagagaaaaaagtgaaaaaagaaaagctgagtgcatgcatatgttgagtactagagatatgtcttcagggtttctttttggaccagatttcttgagataaaatttgcatacaataaaatgcatctgttttaatttcaatgagtttagacaaatgcatatacttgtgtgaccaccgctacactagaggtagggaacccttctatcataggtttctgttattttatttaatttttggggggcctcactctgtcgcccaggcttgagtgcagtggtgtgagctcggctcattgcaacctccacctcccgggctcaagcgattctcccatctcagcctcctgagtatctgggaccacaggtgcatgctaccacacctggctaattttttgtatttttggtagagatggggtttcaccatgtcgcccaggctggtcttgaactcctgagctcaagtgatctgcatgccttggcctcccaaaacgccgggattacaggtatgagccactgcacctggcccaggttcctgtttttattatcgtgggctatagagtttcttttttttgagatggagtctggctctgtcgcccaggctggagtgcagtggcacaatctctgctcactgcaagctccgcctcccgggttcacgccattctcctgcctcagcctcccgagtagctgggactacaggcgcctgccactatgcccggctaaatttttgtatttttagtagagacgagatttcactgtgttagccaggatggtctcgatctcctgacttcgtgatccacccacctcggcctcccaaagtgctgggattacaggcttgagccaccgcgcccggcccggagtttcatacttagcaggaaaaggtgctttgaaccttctaaaatgtgaggtactttcaatattttaaaaaatgctatggaaatgatttcagtgccataagataactctgcatttctctcttttaaatcccacatattatacaatccctcagcaaatcctattggctgccttcaaaatatatccaggatccaacaacttgatagcactttcaccactaccacctgttccaggccaccatctctccaggctaccatctcttatatggattattgtaccagtctcttgcttgtatcctgttcccttccaggcttaacacagtggccagtgatactgttaaaatgtgacaagtcagaaactcttcaaatgattttcacctcattcagagttaaaactaaaatgtttatttacattgtgttacatagccctacactctactcataatactcagtatttatttctgattttcttcatttattctgctccagtcatactgttggccttgctattcctccctcaaatacaccattcctgcttcagcctctttgtatttgtcttttcctttgcttggaagtctctttcccccagatatgaatagggcttcctgcctctgcctcttttaaatctttgttctaatcttcaccttcttggtgaggcctaatcgctgtatttaaaataaactactccatagctctcttccctaatttatttttctacaaagtacataccatctttcaatgtattataatttattttgtttatcatctataggtaacagataagctttgcttatgattatgaaagttaattctcaatcagtttcacatggcaaaacacataaacctgtgttgaaataagtagttggtaatcttttaggctgcttaaagtggacattagtatttatcaaagatgagaaatgttttctgattttccatgagagaccaatcttttttatttttgttttgaaatggagtctcgctctgtcacccaggttggagtgcagtggcgcggtcccagctcactgcaacctctgcctcccaggtttaagcaattctcctgcctcagtctcccgagtagctgggactacgggcgcctaccaccattcctggctaatttttgtatttttaatagagacgggctttcaccatgttggccagtctggcctcgaactcctgaccttgtgatccgcccgcctcagcctcccaaagtgctgggattacagatgtgagccaccgcgcccaggagaggccagttatcttaaaggaatatccataaaaattagctgttaactggtatttttgccttcacctttgaagtccagcctatcaacaagcaagttttggcagctccaaataaaggggaatatgttatggaaaaatttgaagtgaatggaatgggtatattggcataaacgaaaattaaatatatctggttaactctgcagaatgaattacacatttaaaaaccataaaatataacttaaataccaagaatatagagttttactttttttttttttttagacggagtcttactctgtcgttcaggttggagtgcagtggcgcgacctcggctcactgcaacatctgcctcccaggttcaagcaattctcctgcctcaccttccagagtagctgggattacaggtgcgcaccaccacacctggctaattttgtttgtttgtttgtttgttttcttttgagacagagtctcactgtgtcacccaggctagagtgcagtggcgcgatctcggctcactgcaacctcggcctcccgagttcaagtgatctcctgcctttgcctcttgagtagctgggattacaggcacccgccaccacacccagctagtttttgtattttagtagagacggggtttcaccatgttggccgggctggtctccaactcctgacctcaagtgatcggtctgcctcggcctcccaaagtgctgggattacaggggtgagccactgtgcccagctaattttttttttttttgaaactgagtcttgctctgtcgccaaggtggagtgcagtggcgcagtcttggctcactgcaacccctgccacccaggttcaagcaattcccctgcctcagcctcctgagtagctgggactacaggcgcacactaccatgcctggataactttttgtattagatacggggtttcgccgtgttggccaggatggtcttgatctcctgaccttgtgatctgcctgccttggcctcccaaagtgctgggattacaggcatgagccacctcacccagcccagtgtttatatttttagtggagacaggggtttcaccattttggccaggctggtctcgaactcctgacctccagtgatctgcccgccttggcctcccaaagtgctgggattacaggtgtgagccaccgcccctgaccgagagttttagtttttaagcattatttatatctaatattattgggggaaaagtggttttaaaaatgagttcatggcccagtcttgtaaccattgtgaggctaggcactgggccattgctagaatatagtatgcggcatgagatagcataataaatttgtttattgaagtcctcagagtttgtttactgatttattcattaatcagtttattcaacaggtatgaaaaccaactatcctaagaaagcactgagataggctattataatgataatagaagagcttctgtaagtaggacagtagccctttctgttttaaaaagagataccacccccagtttttggttttggtcaaaaagttttacagaaagtttattttaaaactcaacacatttacagtcttgcaatcttgtgtttttcattgttaatatgtactgataacctacctactgtttaaaacatttctaatacctcatttgccaagtatattaaatcctcctaagggctgggcgcagtggcttatacctgtaatcccagcactttgggaggccgaggccgacggatcacttgaggccaggagtttgagaccagcctggccatacatggtgaaaccccgtctctactaaaaatacaaaaattagctgagcttggtcgtgcgtgccttgtggtgtgcacctgtaatcctagctacttgggaggctgaggcaggagaatcgcttgaacccgacaggcggaggtttcagtgagctgagatggtgcctctgcactcctgggtgacagagcaagactccatctcaaaaaaaaaaaaaaaaaaatgcatcctagggattcctttacctataaagttttctaaatattttaagtatactgtgttttctgaaattgaagtttagttttattgaatatggtattatcccaatttaagtcaaaggaattctgaggaagtagagctgtgagcatgtaggtcatgcttttctgttttaaagaaatgtctagtaaacaggtaaacgcatactcaacctcattagtcatgagggaaatgtaaattgaaataagagtatattttacttatgaaattgtgagaattttgacactgatctattctaccaatgatgaggatatgaggaaagggcatacccatattctggtggtgggaatatacatttatatgctagttttcagggatgattttggaggtaaagtttggatacatataattttttttttttttttttttgatgtggattcttgctctgtcgcccaggctgacgtgcaatggcaccgtctcggctcactgcaacctccgcctcccaggttcaagcgattctcctgcctcagcctcctgagtagctgggactacaggcacctgccatcacacccagctaatcagatacatatagttctaacctgtattagagaattacctgtacagatgcatacagttatatgtctattatctccaggaatgttcaacattatttgtgagagctgaaag

SEQ ID NO: 162 - DNA, 1149 bp, Homo sapiens
aaaattggcagggtatgttcaagaacaatgatgtgtcttgactgagttttcttcaacttcatttgaagtttgaaattcagctgcatgaagtactaggaattttgttttgaagagatgttgtggctttttagtaactggtgctatgtcctgtacaaactataaacacttactgattgtccacattatctgcctggagtatgctcagtaccgcacaaaaatgcatttgaactacttttattgagagcaaacactgatgatctacggttttctgtaaaagaagtataacagcttctcatagagctgggagaactatggaaaccctctagtttcactgactcatttaaaatgtggaaacagagtcccacaaagattaacctacttgttgcccaaggtttagcagcatgtcgcacatggatcctgtgctatcatttcctctacccattatctctgttactgctgaatgtcctctaaactggaagttaggctagataaaacattcccccttaaaataggcactctgtgccaggggtccttggctattaggttatgaagcttgagctggaggtagcagccactgccttgcacccctgactacctgacattccagctatgaggcagccagcaatgattgatgggcccttccctgagggcttttgggcacttggggaggcggatgttggcaaggaggtaggagggtgtgtttctttcaccatgacccaaagtcagccaactttaccatcatctatttcattatcagtgtctttttcccagtctccttcctgatactcttactaagaaaataaatacatacataaataaaatgaaaaaagatccagatcttggagctttaaggaatttaagaaccatgagaggtactgcagtggatagttaaagaactgaagggacccttattccctgccactgttggggaaacttgactggattgaggaatataacaggcagggcatgtgttacacgtctgccaaattgtaaatcagctgcaattctataacatcagaaacactgacatggtttctttgattcaggagtggcactgattgaaatatgggacatcatgaccatattctgagctcaagaacactgaaatttatgtatatatacacacacgtatacgtgacgtacataaac

SEQ ID NO: 163 - DNA, 3960 bp, Homo sapiens
ctcctacatcactttaatttataaatatgttgagaacattttaatttgtgtgagtcaataatgtcttcccactgtaaaaaatgaaagaaacaaaggaaatgctgaagctaatgtgaatcacaacagaaccagcctcaatggaatgaatgttagagcagcctaagttcactgggagcttaaaggcttgaggcaggaggtttaggaggaagagagatatggagaagaaggtgaggatctgtcaagtttacttacaatatttttaatatctggccacgtactcagtgaattatattaaagcactttggaaaatgcatacgtactttatctttttaaaaaagcaaaagacaaaaaacaaaactctcaatctgattcttacatcatctacattttgagtgcatatctcaactactaaataataattttgtcagtacactttatcatctactaaatttagaaccataaatcattctgaatgtttctttacacctttaatattcaggttcttcttgggaactaaagggacactgtggctcatcagaatggacaaggaattggagtttatctggtttgcactacttttttggcaaatatttatgagtctctaaagattggattattgacttcaagaactgacttcaaaatcaagatggactccagttcactgatctcttaagacggcattattattattgctaataaatcagttccaacaaacttccttgctaacacttcttttactgatctggagtggaaatttatatgaatattcctctttgagaagagggtggaggttgagaccgttttgattgcaagttatcttgacctggggaaggagtgtcattgaaattgctttcttggtatttgctataatcttgtatgtcaacttaaggttctttctgtggatgcaaccaaaagctattctcaagaggaattaattagcaggctatctgggattcgtggaatccatgctggataactgaatttggaaatgaacagacaggtgggtagttctggagtctgggaagaaagaaaccttgatattaacatgagcagtctgctcatgatcttaccgcttggataaaatggacacccacatgatttcattgttttctgctaattattctgctaagaatcactgtttctatccctttgttagagattcaaattctagagaaaattctgaaaatatcagtaatttactcatctgtttagttaaagggagaggcagggggtcaatctttttattatagttccaatgaactataactagttggaataaaaaacacctcaaaagtgaattggattccagttgttatatagactccggaaaatcaaaagacaaaaacacctttcatgaggaaagggaagctacagcaaagctgggaatatggaaagacgaagcaagcctttctttttgttttgctgagaggggcagttattacttattatgaatattaaaaacagaacctacaataaaaatagactgtaagagctttagtaccgagtgaaaaatgtaaaattatttgagtcatgaacttgtcccaagataaatgtggaatcaatgctaaaacctgtatagtactttaaagtaaatgtaagataagacaaagatgattgttattaccattatcaatactgatttagaaattctaactaatgaagtacagtaaggaatataaatcagaatcataattattggaaagaagataaaacttagccttgtttgaggataacatgatttgtataatgaaaacccaaacgagtcaactgaaaagctaatataaactttattatataaccagcagtaatgattacaaagaaaacataatggttttagaaaaaaattcagaataggcaaaacatacatagagaaaagcacaaaacacttcagagtaatcttaagaagaattatgggagcaaatgaagaacagcacataaaattactgtaaagtatagaaaactcactaaatgcttgtttcctttttaaaatttgacagactggactcacaggtgaaaaaagtcaaactggtctcacaggtgaaaaaaactcttttgaaactgagagtgattagggacactacttatttagtcttgtgtgtactaaattaaaaacataaaacataatgtttttaaaagtactagagcaaaaattgatacagatcattgaaacaaaatatatactccagaaacagactataatttctggaaggatttcacatatcctccggagatcctcagatttgtaaacagaaatttatacgcagcagtgtgcatttagttacgtttaaaatcatttgccttaccctaacttattcatgagcagaaggtaaatccaaatccccagtgatactcaatctgaaacagaccatgtgaagtttgtattcatcagctcaattgctgatgaatgcttgtaatttagaatgtttgcccacttcctttagagaatcttatttgaaaccattatttgttcctcttttgtatttttatatatgccatctaaatagccatggtacatctagtctgattatacttcttgttggccctcatgtttagctactttgatggatgactgcttctccttctgtgtattgtggagcccagcaaagtgaatttgtttaataccaggtagcctgtgttttgaaccctatcatgccagatatgaccttaagacatggtaaaatccttctagacattttcatgacttcagtggcaggtaaaaagcaggaatttcatttaatttatattatttttagaaaagttagaaacaactggaattaacaatagggaatggttaaaaatatatttgtacatctgtgcagtcacgttatacagccacaaaaagggattactcatagctcaaacctcagcatcatgcattatatttagttaatatgtgcacatatgccccgactccaaaataaaagttgaaaaagagaaatattaatataaaataaagaattttagatgatataatccttaccaggaagtatactatgaataacatttttttaatttcatttggtttgtatatattttatttttatattttcctttatttttcaaatttcttagaagcatgagaatcagaaaaacataatttaaaaatgtgaagatcaagatatttaaggattggaatatatattaacaatacaaataaattatgtgtcaacaattatttagcggtaacatttaatgtgtgtacttttagttgattttactaaaagacttatacacatatgtgaccaggacatgtatacgtatatgacaaaatcattctgatttgcatcctcaaattcagccctatagtttccaccactgaacagctgactaaggtaccacagtaaactcatggcagttcttctaagggcaggaaaagttatataaaatgtaggcctttaaatactggatttgcaaagttccattatgtgtggtaagaatggaaaagcgtatacctactatgtcccaaataggaaattacctataagcatcataatttaactcaccatacatactttgactcaagtaactgatttaaaaaaaaatccatgtggttggtgcatgtggttcgttatgttgtgttcataaatatgatcatcaaccgatttgcaaaacagtaaaatataataattctatgaactcaattccaaaaataatttacacctggatgaatctttttggaaaattttaccaaacagcatcatcttcagtgcttttctaaaccaaggatagaaaaatgcataaaccattggattaaatgtagagttcaagtagccaaaccaaatcaatacatcattcaaagtaggtggaataatgtagtgaagaaaagggtccatgactgtacagataaagaaagggcaccagcatattaggaaaactcccatcacaatccccaatgtcttcacagctttcctttctttgctttgtgaaattccatttttcatttccaatccaatttggagc

SEQ ID NO: 164 - DNA, 19433 bp, Homo sapiens
caaagaaccgttgatatttgttaacacgaatgttatttagatatgttatagtataatgtgaataaaatttttgtaaattatgctaacaatcctaccaatttaacaaatatttataaagggttttttatttttgttttttgttttgttttgagatgaagtcttgctctgtcacccaggctggagtgcaatggcgccatcttggctcactgcaacctccacctcccaggttcaagtgattctcctgcctcagcctcctgagtagctgggattacaggtgccccccaccgcacttggctaatttttgtatttttagtagagatggggtttcaccatgttggtcaggctggtctcaaactcctgacctcgtgaacaatccaccttggtctcctaatgtgctgggattacaggggtgagctcccacgtccggcctcatttttgtttttgtttccttcaacttttattttaagttctggagtacatgtgcaggatgtgcagttttgttacattggtaaatgtgtgccatggtggtttgctgcacagatcaacccatcaccttggtattaagcccagcatccattatctgttcttcctgatgctctccctccccccatcaggccctccccgcaacaggcctcagtgtgttttcttccctgccatgtgtccatgtgatctcatcattcagcgcccacttataagtgagaacatgtgttgttttgttttctgttcctctattagtttgctgaagataacagcttccagctccatctgtgtccctacaaaggacatgatctccttcccttttatggctgcatagtattccatggtgtatgtgtaccacattgtctttatccagtttatcattcataggcatttgggttgattccatgtctttgctattgtgaatagtgttgcaataaacatacaggtgcatgtatatttataacagaatgatttatattcctttgggtatatatccagtaatgggattgctgcgtcaaatgctattcctgcctttagatctttgaggaattgccatactgtcttccacaagggttgaactaatttacattcccatcgacagtgtaaaagctttcctttttctctgcaaccttgccagtatctgttgtttctggacttcttaataattgccattctgactggcatgagatgatatctcattgtggttttgatttgcctttctctaaagatcagtgatgttaagctttttttttccatatgtttgttggccacatgaatgccttcttttgagaagtgtgtgtttatgttctttgcctactttttaatggggttgttttttttcttgtaaatttgtttaagttccttatagattctggatattaggcctttgtcagacagacagattgcaaaaattttctcccattctgtatgctgtctgttcactccgatgatagtttcttttgctatgcagaagctcttaggttcaattagatcccatttatcaatttttgctttggttgcaattgcttttggtgtttttgtcatgaaatccttacccgtgcctatgttctaaacggtattgcctcagcaatactcagcctcagcccagttctgtgcccttgctggagaggtgttgcgttcatttggaggagaagagacactctggctgttgtgtggtctccctgatgtcctggaatgtcctagccaattgagtgatggtttttctctccagtgcatcctccctgaccagccagctcttccttccccagctcttgccctgcagtgactctgaaagcttgttgttccatttactgcttgcactcactttatttcacagagtaaaaggtgctttgcaaacataagtttatgttgtttgtcttcagctccccctgtattctctcaccatgtcattggcgtggagaagcaggaacctaaacatgggaagtgaacatcaaaatatgtcatgatcacagtgtgcttcaaggtaaataccacttcagcacgatatccatttgtataaagcttaaaaataactgtcacaaagtaatatattttcagatatatctatatttacatctacatctcccctgtctatacatagatacatatctagactataaagaaaagcacagggattatgaacataaccttcagaagagtggtcacctctgttgcgaagcaaggggactggatcagagaagaaattccagcagtcctgtagcttccacaggactagaaatgtttcatactgcatgaggtcatgggtttatggatgttatttaattgttatgcttcataacttagatgcacatcccatgttgagaatacaacatgttacatttatatagtgggaaactctacagcaatgagtttgaacgaactacaactatatgcatcaaagtagctgcatctcataagcataatattgagggaaagaaggtagagaagagtatactgaataattcaactcctaaatgaattatcctattagaaatcagaagtaagtcaggcagtggttagcctcaggagggcggtaactagaaggaggcttctaagtactggtaatgttttgctctttggtctgagtactggttatgagtactgagtacatactgtactgtgtatttacactgtgaatgctcattgaacttcatacttgtgatttgtgcacttttgggtatgtttgttatacctcaaccaaaattttacatctcaaagaagtcaacgctggcctttgtcacctacctctgcacaccataaaaagtgtgattaaggctgggcacagtggctcacgcctgtaatcccagcactttgagaggctgaggcaggcagatcacaaggtcaggagttcgaggccagcctgaccaccacggtgaaaccccatctctactaaaaatacaaaaattaactgggtgtggtggtgcgtgcctgtaatcccagctactcaggaggctgagtcagaaaaattgcttgaactcgggaggcggaggttgcagtgagctgagatcgcaccactgcattccagcctgggtgacagagcgagactctgtctcaaagaaaaaaaaaaaaaagtgtgattaaatagactgatgaatgaaacagaactgaatgtctatgaatagatcctaatacatgtggcactttacacaatgataaaggtggcttttcaaattagtgataaatagaaaattcaacaaatggtgttgggataaatgagtagccatttggaataataaaaattagtttagctctactttatatcttacaccaaggtatatttcagatgaataaaagattctttttatttttttaagagacagagtcttacgctgtcatccaggctgctggagtccagagactcactacagccttgagctcctggactcaagtgatcctctctcctcagtctgctgagtagctgggactacaggtgtgcatcaccatacctggctgcttggctaattgttagttttgttttttttttctagaaactgggtctcactatgttgcgtaggctggtctcaaactcctggaatcaggtgatcctccaatctcagcctctcaaagcattaggattacaggtgtgagccactgtgccaggcccaaaagatttaaattttaaaataaaacaataaaatgagtcaaagaaacattgagaataatttttataactttacagttctttttaaaaagcacaatatagcaaaagacctcctaaaactagaagactgatgaattaaattgtttaaaaatgtgtggcaaaatccacaataaataaaaagttagataacaaattgggaaaaatatttccaattcataatgcatatagacagctaacatcaccagtgtaaaagagctctttcagatcaataaggaaaagatgaataagccaccagaaacatggacaaaaagtatacacaaacagttcattgaaaagaaataaaagtgactcaaggccaggtgcggtggctcgtgcctgtaatcccagcactttgggagaccgaggagttcgagagcagcctgaccaacatggcaaaaccccgtctctactaaaaatacaacagttagctgggtgcggtggcacaggtccgtagtcccagctacttgggaggctgaggcaggagaatggcttgaacccgggaggcagaggttgcagtgagccaagatcacctccggcactccagcctgggtgatagagcaagattctgtctcaaaaaaaaaaaaaaaaaaaaagtgactcaaacgtgaaaagatgctcaacctcactcatgatgaataaaataaaaatgaaagctacaaatatattattcctgtagtgctggagtacaccaggtattatagaagtattttaaaatacacttagttggcaagagtatggggaagcaggtactttcttacgttgcaggtgaataaaagttggtgaaatctttaagggcaatagtttactgaaaggcaagatctattaatattacagatgaatataccatctgaacatatcatttaatccaataattttactttgggaatatatcttacaaatatgttagaacataagtaaaattacacacacacacacacacacgttattaatcttattttgagtagcaaaaaattggaccaaaaaatactaatatctatcaatagaaaattggtaaataaaatgcagccatccaaaagaataaaaaacaattattttacaaatatggaagaacttcaagtgacaaaagcaatgtgtaggagttgtataatattatatagtatctatcatttatattttttaaaaggtaaaaaatatactttatagacttagaaataaaattaacaatagaagtataaatcgaactcataaaatataagtgaatagtaaagggttgactcagcagctatgggattgcatgcctcaaagaaaagactgactcttgaccaactattagctcttgaaatatcctgcctgataagagtgtctttgtatacctcgggccttgggcaatgccagagtttgtgctaataatgtaatttatggtgaacacctgtttttgcttgcctggagccctgggtcatattgtatgagtttgacttcatagggaggaatgggttggagactgagtattaagggtcaatagtcgggggtcttcatgcctatgcagctgaccttggacacaaaagtttgtgtgagcatccctggttgacaattctttgtccatattgtcacacgtcattgctgggagaattaagttctgttcatataactccacagggagaggacaactggaagctgctcctggttctgcctggactctgccctaagtgccttttccttccgaatgtattctatagcctttcatcgtaataaaccataaccgtgaatagaacagcttgtctaagttctgtgagtccttctagctccttattgaatacggtggcagcattgggtccctcaacacactagataaagtaattagagaagcatttatttttttcagatgctggcattgaaaaggaataaggactacttattgagttaagtattcagtttaagatgttagataaagggcaacaaaataaagaaagtagaaggggctgtctactgtttaccatcacactttgctgcctctcttggacaatctatagacaaagttaataaaagagtgcaacaagttttccgaatgcagaattgatatacaaaaaaagattgcatttctatataccagcaacaacaactcagaaaacataattttaaatgcaacactactaaaaataacaacataatcattatggaatcatgaagatgtcaattctcccaaaattaatccataaacttgatgcaattccaatacaaactcaagaggatttttttacaatactgaacaagctaatgtcacaattcatgaggaagagcctatgtttaaaaacaaagcaccaaagtgggagacttgttctaccagatttaaataattattaaaaagttaagttaaacagtgtagtattggtgcagagatagatgtataagctaatgaaatgaaagagggcctagaaagagcccaaatcatatatggaaatataaatgacagacatggcatcagaactcagtggtaaaagatgagagtattcatctcccatctttttcaaaagatgttgaaattcaaagggtgttgaaatttttggctgttgatattataataaaaataacatttggtccttgtccttagttcctgacacacagctcctgaagtccttggaatctccagagtgatgactgagttaatcaccaatggtgaatggcaatgattatctgtgaggaccaaagctgagtcttcgtgcttagggcaggagcgcagacaaggagaggggctcttccttctgaggcttgtcatctagaactcattgtcactggaagccagagcctaaatgggcctatcagttgccttgggttataagaacaagtttgagtatttattcatttatttatcttgagttcggggcccctgtgtatctgctcactgcctgcccgcagttcagcttgtgcttggctcactcaccattcagcgaaatgaaggaaccagcggaatgaaggaaccagcggagggacctccgggaggaggcgctgcccagcgagcctggcgccggggggcggggcctgacgggagctctgctcaggcttcaacatggcgggccgtttcggttgacttcgcctgtggaaaccgaattccccctccatggtttccccaggatatgagttgggggcctcacctcgcctataagggtcaggcgagctttctggatgctcgagggacctttcggcctgcgcagccggagcagcttgtcccaatgccctgccatttctgtgagggcccacgaggcctggaggagcctcggagcccccgcaggccctcgcgtcactgcctcaagagggtgctcggagccctgctcgggagctggtccccaacgaggtgtggaaccccttcttgctggaactccacggagagactggtaataagatagtaataagaccgactactgtttattgaacctccgctagtcactggctgtcacgggttgggcgagaggtggaatataaggcccagagttcctctattatagccatggagagccattaatacctgcttaatagagttgtggtgagacatggaatgggcaagaaaggcactcgatttatttgatttttagaatcatgattattattattattttgagacggagtcttgatctgtcgcccaggctggagtgcagtggtgcgatctcggctcactacaagctctgcctcccgggttcaagcgattctcctgcgtcaccctcccgggtagctgggatgacaggcgcgcgccaccatgcctggctaatttttgcatttttggtagagacgggttttcatcatgttggccaggctggtctcgaactcctgatctccactaatccacccgccttggcctcccaaagtgttgggattataggtgtgagccacctcaccagaaagtgccaagaaaggcactttagacagtgccagagttgaggatttggcctctgactcgctgcagttgccacactgcagttgccacactgtggccttagaacagtcttatccagtcctgaaaaccccagtgccttggaaacatcaggattggtcagaaggacagtaagtccttaaggcgccagcccctgctcctccccccagattgaggggtaagtattccaagctctatgcaggaccctaatcctggatgtggacacccacagtcctgctaggacctgcttccagaagagttgatcccagccgtgaaagtgcatgatgccttcagcgaagcaggcaggaaaggctcaagtgatcctcctgtatcaccctggtgagtagccagtagctgggaccacaggcgcgcaccaccacgcctgcctaatttctttgtagagacggccttcgtcatgttgcccaggctgctctggaagtcctgagctcaagcgatgcgcctgccttggtcttccaaagtgctgggattacaggcgtgagccaccacgctcagcccaatttgtgatctttcatgcactctttcatgtagcatgttttcaaggttcatccaacttgcagtgtcttaatgctgaataatatttcattgtgtagatataatgtatttttcaagttttgtttatttttaattggtacacaacaaatatttgtacatatttgtgtggtacatatgtacatgtgatatgttgttacatgcatagaatatgtaaggatcaatcagggtatttaaggtatctgtcactttgagtatttgtcattgccatatgttgggaacatttcaagtcttctcttacagctattttgaaatatacaatacattgttgttcactgtagtcaccctactctgctatagaacattagaacttaactccttctatctaactgtattaaccaaccactcttccctgccaacccacacacccttcctagcctctggtatctatctgtccaccgtcaacttttttagctcctacgtatgtgataacatgcaatatttgtctctctgtgcctggcttacttcacgtaacaatgacttccagttccatccaggttgctgcaaacgacatgatttcattctttttttatggctgaatagtacttgattatatatatcgcattttctttatccatttgtctgttgatggacacttaggcagattctatatttttgcttgtgaatagtgctgcggtaaacatggaagtacaggtatcatccctttgatatactggtttttttcctttagataaacagccagtagtggcattgctggattgtatggtagctctattttcagtttcctgagaaatctccatactgttttccatagtgactgtactcatttacattcccacacataagagttcccctttctctgcatcctcgcccacatccattattattttgtctttttaatcatagccgttctcattgggtgaagatgatatctcattgtggttttaattttcatttcccttattattagtgacgtcgagcattttttcatatacctgtgtgtcttctttggagaaatatctatttatgtcctttgcccacattcgttcattcatttattggagtcagggttttgctctgttgtccaggatggagtgcagtggtgcaatcacgagtcactgcagcctccacttcctggtctcagatgattctcctgcttcagcctccagagtagctgagaccacaggcacgtcccactgtgcccagctaatttgtatgtgtgtgtgtgctttttgtttttgtttttgtatttgttttttttttggagacaggatgggagtgcagtggtgctatcactgctcattctagcctcaatctcctgggctcaagtgatcctcccacctcgttttttgatttttgtagagatgaggtctcactatgttgcccaggctgggcttgaactcttgggctcaagcaatcttactgcctcggcctccccaggtgctgggattacaggcatgagccaccaaacccagcctaatttttgtatgtttttgtagagacggggttttactatgttacccaaggtggtctcaaactcctgggctcaggcagtccacctgcatcagcctcccaaagtgttaggattacaggcatgagccatcatgcctgacccttttcccacttttaaatggaatgattattattttttactgttgaggtgtttgagtttctcgtgtattctagatattaattccttgttggatgaatagtttgcaaatattttctcccattcaacaggttgtctcttcactctgctgtttcctctgatgtgcagaagctttttagtttaatatagtccaatttgtctacttttgtttttgttgccgtgcttttgaagtctcagccataaaatcttttcctagtgtcctgaagtggttcccctaagttttcttctggtagttttatggttttggggcttatgcttaagtctttaatccatcttgagttgatttttgtgtatcgcgaaaggtaggaggttagttgtgttcttttgcatacatatggatatccaattttcctagtaccatttattgaagaggatgtcctttccccaatgagtgtccttgacacctttgttgaaaatcagttggctgtaaatgtatggatctatttctgagttttctattctgtttcattttatacctgtttttataccaatactatgccgttttggtcactagagccttgtaatatatgttgaagtcagatagtataatgtctccagctttctttttacttaggattgcttctctattcgagctcttttttggttccatatgaattttaggattattttttctacttctgtgaagaatgacactggtatgttgatagggattttattgcatctgtgtattgctgtgggttgtatggtcattttaacaatattgatttttttctgatccatgagcatgagttgtcgttccatttctttatgtccttctcaattgctttcatcaatgttctgtagttgtccttgtagaggtttttcacctacttcgttaaatttttttcctaggtattttattttcttgagctatgataaatgggatttccttcttgatttctttctcagctagtttattattggtgtgtagaaatgatactaatttttgtatgttgactttgtatcctccaactttttttttttttgaatggagtcttgctctgtagtccaggctggagtgcagtggtgccatcttggcccactgcagtgtccgcctcctgggttaaagccattctcctgtctcagtctcctgagtagctggaactacgggcgcacgcaaccaggcctggctaatttttgtgtttttagtagggatggggtttcaccgtattggtcaggctggtcttgaactcctgacctcgggtgattctcctgcctcggtctctgaaagtgctgggattacaggcatgagccaccgcacctggctgtatcctataactttactgaacttacttatcagatctaagagtttttggtggagtctttaggtttttctagatacaagatcatgtcatctacaaagagggacagttttacttcctcttttccaatttggatgtcttttatttgtttctattgtctgattgctctggctaagacttccagtactgtgttgaataggagtggcaaaaatagacatccttgtcttgttccagttcctagaggaaaagctgaaagccacgataggatggtgttaactgtgggtttgtcatatgtagcctttattatgtcgaggtattaataggctccttcaatgcctagtttgttgagagtttttatcatgaagatcttttgaattttatcaaaccctttttctacatctcttgaaatgatcatatggttttgttcttcattctgttgatgtggtgtgttatctttgttgattgatgtatgttgaactacatttgcatttctgggacaaatcccacctgatcctggtatgttatcttgttgatatgctgttggattcagttggttagtattttgttgaggatttttacatctatgtttatcagggatattagagtgtaactgtttttttttgttgcattcttatctggttttggtatcagggtactgctagcctagtagaatgaggaagaattccctccttttcaattttttggactagtttgaggagaactggtgttagtttgtctttgtaagtttggtagaatttggtagtgaagtcattagcagtgaagccattgggtcctgggcttttcactgtttggattcttttttattatggattcaatttcattactcatgattggtctcttcaggttttctatttattcctgattcaatcatggtaggttatatgtgtcaaggaatttatgcatttcctctaagttttctagtttattaatatatagttgttcataatactgtctgatgacttttggtatttctgtggtgtcagttgtaatgtctacttttattcgtttatttatttctttattttttgacacacggtctcactctgtcacccaggctggagtgcagtggtgtgatcatgactcactgcagcctcaagctcctgggccgacgagatcttcccaccccagacttctgagtagctgggactacaaacatatgccaccatgcccagctaatttttgtattttttttttagagacagagtttcgccatgttgcccaggtttgtctcatactcctgagctcaagcaatccacctgcctcagcctctcagaaatgctgggattacaggcattagccactgtgtctggtaatgtcttatttttcatcttggattttgtttatttggatcatctttttcattttcttgtttagtctaactagccgtttattgattttgcttacctttttgaaaaaggaactttttgtttcattgattctttatattgtttttgaaatctatttcatttagttctgctctgatctttattatgtctgtccttctactaatttgaggtttgctttgttcttgcttttctagttctttgaagttatcattagtttgtttatttgaaatctttctacttttaaaatataggtgtttattgctataaacttccctcctagcactgcttttgttgtatcccataggttttgttatgttgttttcaattttcacttgtttcaagacatttcattttttgagacagggtctctctctctatcactcaggctggaatgcagtggcgtgatcttggctcactggaacttccacctcctgggctcaagcaatccttctgcctgagccttctgagtagctgagattacaggcacacactagcatacctggctaacttttgtatttttttgtagagacagaatctcactatgttgcccaggccagtctcaaactcctgggctcaagcaatccacccaccttggcctcccaaagtactaggattacaggcatgagccaccacacccagcctgtttcaagacattttttgatttcctctttaatgtcttccttgagctaaaggtcattcaggagcatgttgtttaatttccacgtatttgtacagattccaaagtttctttgttattgatttcctatcctatgtcactgtggtctgagaagatactggtatgattttgatttttgaaaatttgttgagacttattctatgtcctaacatatggtctatcttggagaatgtttcatgtgctggtgaagaggtatgtgtattctgtaactgttgaatgaaatgttctataaatgtctgttagatccatttgttctaaagcacagtttaaaatcagtgtttctttgttaatttcctgtttagatgatctgtctaatgctgagtagagtgttgaagtcctcatctattattgcagtctatctctccctttagatctaatgacatttgctttatatatctgggtatcccagtattgagtgcatatatgtttagaactgttacatcctcttgctaatgtatctccatgtcattctgtagtgaccatctttgtctctttttactgttttgtttgtttgtttgtttttgagatggagtcttgctgtgttgcccacgctggagtgcagtggtgtggtctcggctcactgcaacctccgcctcctgggttcaagcgattttcctgcctcagcctcctgagtagctgggattacaggtgcctgccaccatgcccagctaattttttgtatttttggtagagatggggtttcaccatgttgaccaggctggtctcgaactcctggccttgtgatctacccgcctcagcctcccaaagtgttgggattacaggcgtgagccactgtgcctggcctctttttactgtttttgacttaaagtctgttttatctgatataagtatagctgctcctgatcacttttggtttccctttgcacagaatatctttttccagtcctttcctttcagtctgtgtgtctccacaggtgaggtgagtttcttgcagttggcatatatttgggtcatgtttattttttaaatccgttcagccagtctgtgtcttttcagtggaaagtttaatctatttacattgaagactatttttgatatgtgagggttattcctgtcattttattaattgatttctggttgctttatatgtcctttgtccctttctttctctcttattgttgatcattgtggattggtggttttctttagtgataacttttgaattgttcttcttatttatgtgcttgctctaccagtgggttttatactttcatgtgtttctgtgatggtagatatcatccttttgcttccagctgtaggactgccttacatgtttcttatatacctggttgagtggtgatggaaaaccaacggctaccattaaacttagtggtgaaagtcttaaagcttttctcctaagatgaggaacaagccaaggatgcctgctcttgctttttctattcaacattgtactggaggttctagccaggataattagacaaaaaaaccaaaacaaaaccaacaacaaaaaagaaaaagcatctagattggaatggaaaaagtgaaactgtattttttgcagataaataatgttgtatatagaaaatctaaggaacccacaacaacgataacaacaacaaacctgccggagcaacagttgagttcacaaaagatataagatcaatgtgcaaaaagttatatttagaaacactagcaatgagtagcctgaaaatgaaattaagaaagtaattttatttacaatagcattaaaaaataagactaaaacaaaagaaatgtaagactacaaaacattattgaaagtgattaagtaaagacctaaataaatagatacacattctgggtttattgaatggaagacattactgttaagatgacagtactccacaaattgatctacatattcaactcagttcctatcagaatcctagcttctattttgcagaaattgacttgctgatcctaaaattcatttgaaaatgcaagggactccgaagaagcaaaatgatcttgaagaagaacaatgaagttgcagagtccacactttattatttcaaaacttacttatagtggttaaaattgtgtagtactggaataaggatagacatgtagatcaatggaatagaattgagagtccagaagtaaattcatacatttaaggtcaattgattttccacaagggtatcaaggccattcagtggaaaagaacagtctcttcagcaagtggatgaagttagatctcttcctcacatcatacagaaaaatcaacctcaaatggaagaaatatctaaatgtaagatcccaaaccgtactcttagacaaaaacataggtgtaaatttttctgatactgacttagtaatgatttctttttttcctctccttttatgtgggacaggaaaactagaggggtttagagttgtcttactgcttttcccctatgtcagacaaggccctgataaagcagtttttctttagggcagggctttcacacagagaatagaatgctctgggcatatttcaaaatggttgctgtacccactcactctatccaccaactagggtatattttgaaatggttgcttttcccttttccttgcctaaagagcctgaggaaattttcttcagccttcatcatgagaaccagctagggtttctggaagtaacattcatgaaagtataaggggttcccaaggcgggacttcaacaagtttttaactctcaagctagtccacactcagccaccggtaattaattgactagcatttaagtgttcctaccaattactggctcctgtggcttctgctctcaggtaaactgtgatgttctgtagtcacgtgtctctctagtttttgaggaagtggtttgccctgtgacctctattctctgacagatctaagaaaagttgttgattttcagtttgattatcttttttcctgttgtgaagatgggagtgatgacttccaagttctctgcatgttggagtgggaactggaagacctaattaacttcttaagaaactgccaaactgttttccaaagtggatctagcactttacattcctggcattgtatgagagtttcagtttctctctatctttgtcaacacgccatctttctaattttagatattctaataggtatctagtggtttcttattgtagtttgaatctgcatttctctaatagctagttatgatggccctcttttcattggcttgtcagttgcaaatctttattagtgaagtatctgttcacatattttgcccattttttaaaagttgggttgttttcttacatttgaagtttattttttcttataatcaaaattttaatgtatacataacaaattgtacatatgaggtacagtgtgatgtttcagtacattttacatggtataatgatcaaatcatggtaattagcatatccattgccttaaacatttaccatttctttgctgtaagaacactcaaaatcctctcttctaactagaatatgggtgtattttaaatgtacacctatttattttctcacaatcctagaaaatgatagcttgagtcaatgaagtttcccctgcaagtcctatcaaccttgcttactttagtgaaatttaatatggtctagaaaacactgagccctctggttattctctctaacccacaaaggaagccgaacacttgataaaaagttcatcagcgtaaataagaagaatcccctccattacatacaaaagaaaaaataactggagagatcatctctgctctaaggtgattatcctgtggtctttggttttggtacgttctccccgaccccatgcccttttccctcatctttaatgagtatctgtatgtgtggcagaacagcgtgtttttaagtctctgcagtcttggaccaagctcgttttattccctactctacgagaatctcaagagcaccaggattctgtttggagttgccatggacacagagttcttaatccagtactggcttattctcaatacgaggtaaagacctagaggtgagggtctctgagcaaggtagtcccatcccatcctctgccctctctgttggctaatgttgtcctctcatcctcatcaggagaattaaaatcatgtaaagttttggtgggggaactaggtggtggtttctggggcccacagacaggaaagtttgcttatagccagttggggggaccactaattgatattcctttcccctcccagggaccttacggagtccccttatcctcagggtactgggggacaactagtgggtgtagggccaaatagtaataaccttgttatttgccaggaatggggtaaagatttgatctaacaagcttggttttgggaattaaaaaatgaaaaaaggaaaagctataatcctgaaaggcaacaggagagaaaagtgctaacaggatcttgaataaatttctccctcttagagaaagttgtactgaagacacgagacctgagacttgtgtcattttagcggctgaaccgaccccaacttcttctgagcggcagtggcgccagaagcagtctggctttcaggtaagcaggtccagggcttacagggagaaactcccaggtatccagctctgccttgggttgccctggttcacatccaaaggtgtgcttgggccacatctctggagcagaaggtggtagactgagagctttgatatttctatttctattgcacatgagctggtataaccccaaaggtatggaatttgctgctgtctgtgacccagcaaatagaaataggaaagtaatgaggtagaaaaataatagaaatagaaaaaaaattgtaaaaataaaataagcttcattctatgcctgttaatgtccttaaaaataggacatttttaggcagtgtgataacatgcatctactggttgctttcatatttcctataggggtggctgcttgccctaatggtggatgctctgttcaggatggtgacctagtgctcagctctggaagccactccacagagatggccaccgaaagggcttcagtggtcccatctcaacacctgaaacattgttaattattacagtgaaggccacaaatgggcttttattagtgagattggtgacttacaaagcagcatgatggttgttacaattatatgacattttaagatctgtgaatcagctaaagtgttttggagacagcccacccttgcataaacaggataaaggtttatgaatatggcctgtagtgtatacttagagatgacaccccaggcttgatcctcatatggtcctatctccaggaaggtttaggaagattttggcctctggaatattaggattctgttgagaatgaacctttcatgcttggagcacctaaagtacagaaagcttacagaagcttatgtaccgtgcctgcttgctactgaatgttttgttaaatgaatatctgtatgtgtggcagatttgattggagagctgcttttcattataacctggtagcctgattataaaggtgtagctaaccttcacctaactcaaacttctgtggtttctcctgtctaccaaaaagcatttaagaattctgcgtgatcacgttattttaggatagtttgccattctcaccttccttagaaggcaatttagctagctacttatgcatgtcccatgagggaagtcagtctgtgctcccaagcagcttatcaaagtatgatttcagacttcatgcaatactctccctgaaaggagttcaggtaacatgtatggatgtcttgtgtcctttttggagattagtttcccaaggaactcgcttagcagtcctggcttgtcacctggatctgaagagtaatttgagtgtcttcccattctcttcctcggtagaagatatctgaaaaatccagtaatcattcaataaggctgcttatgtcagaaactcaaattcttatgtttttggcgttttgaacattttcccctgttatgacttattagtgtattctgcatagacaacccagttgtccttcctgcagaaaagcagcagatacctctagatgcctttctttttgtaaaaggtattgtttttcctgagacctggatgaatttccatgagccattcaagggcatgagaacacccacttagaacttgagaggttcccttcatggccctcagactgggctaacgagatttgataatttgaactccagcactcctttcctcacaggctgaaagaatagcacagtattaatgtctatctgcgcttaaaggtttgagctatcgaccacagtccaaaattagtttgtgtaggagaacttttacttaaagacataaaaagataccgtttaatatattgcttctaaaatgtgtttctcacacatttccactgtgagaacgaggttctgtggtcaaataagtccagaaacctcagcatgctctagggaatcccagtttttatc

SEQ ID NO: 165 - DNA, 12770 bp, Homo sapiens
atttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcgggtcactgaaacctctgcctcccaggttcaagcaattctcctgcctcagcctcccaagtagctgggactacaggcatgtgccaccatgcccaactaatttttgtattttagtagagacggggtttcaccatgttggccagggctggtcttgaactcctgacctcaagtgatttagccgcctcagcctcccaaagtgctgggattacaggcgtgagccactgtgactggcctaataaaattaagatttctcttcattaaaagacactataaataaagtcaagccatagtgctggctttggcagcacatatactaaaattggaatgatacagagaagattagcatggcccctgcacaaggatgacatgcaaattcatgaagcagttccgtatttttaaaacacatgcacacatatgtttattgcagcactatttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatcaatattacgagacaggaacccaattaaaaaaatgacaccaccaggcgcagtggttcatgcctgtaatcccagcactttgggaggctgatgtggaaggatcatttgaggccaggagtttgagagcagactggggaacatagcgagacccccagctcctgaaaaaataaaaaaattagctgggcatggtggcatgtgcctataatcctagctactctggaggctgaggtgggaggattgcttgagcccagggggtcgaggctgcagtgagccatgatggcaccactatactccagcctgggcaacagaacgagactccatctcttgaaaacacacacacacacacacacacacacacacacacacacacacaaaacaatgacaagaaggcacaatttggcatttcacggaagagaaaacaagtggcctctcagcatatgaaaagatgccaaacctttctaatcaggataaggggcataaagaccatagtccttggttggtagaaattaagatgactgataactgtaagtgttggtgagagtgtggtttcatagaaattcttgtgctgctagtggaagtatttgttgttacctctgctttggagagcagtttggcactcatttacaaaactggcctttcgtacaacctacacaccagcgactcctctctgctctttagatgtagagtccagagcaaggactggtaaactctttctgttacgggcaagagagtaaatatcctaggctttgtggactacatacacacttagtctttgtttttataacacttaaaaaatctaaaaagcattcttagttcaaagaccttacaaaaataggctgctggctggatttgatttgcaggctgtagtttgccaattcctggttctctgatctaggggacgcatcctggagaaacttagttacatgcagtcttagtggcaggagggccaggggaaaagcacagagcggtatgggggagttgagagagactgggagggtggcctcctggagaaggtcgggggctggactgcatgtgtctgggtaggctcagccatggcctggctgggtgggcctaggggaacgtagagcttctgaggcacaataggccagtgtggagagcagagtggcaggcagggctgggggctgcaggtcgaggctggtcaacccttttacctggcgggcaaggctagtaccaggtgcccttgctacttagcttggaaagattagtgagcatcataatggaccggcaagtttgtaagcaaatgacatctataatacatatactttaacattaatgttttgaaaactttgttttcacaaataagtaatttcccacattttgccacagttatgttctatgaagctaacccaagtgtggctagaacgccagttcatccatctctcaaattgtctgctgccggcgttcattcctgtttgcttctagctgtaaagtcaggctaggagtctgtcagctcatgtgcctgtcagcttcatgcaggcagcaagaacggggctcggaagcaagggctccgcccgcccacccagcaactacctccccaggatgcccaggagctcaggggtggaaggaatttggctcttatttttctaagtagcaaaaatagatgaattgggtacaggaacgcagtgtatttttgagggagctggtgagttgtgaaagaaacttcctctgttcacctgaggcttaccgtatcgtgagaaaggatggaggaggcatggaggtgggaaactctacacaagaaaaatcctatagtgcagcagctactgatgtgaggcggctggtctaggcagcggtgttccctgaggctcctgagtctggttctcactgggtccctcacctcccttcacagccactcccttccttaccaaggtacatgggagtacagggctggccaggggctgttgacagtgggggagtggtgcaggctgagccttagagacaggaagggcatctgtgctggagctgccctgcagaagcctcgtaaaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaacaggcaggagtttcttagaaataacctttggactaagatgttgtagatcgtgttgttagaaagagtgagagggagctgggcatggtgccttatgcctgggatcccaggactttgggaggctgaggcaggtggatcacttgggctcaggagttcgagaccagagtgggcagcatatggagaccccatctctacaaaaatgaaaattaaaaagttacctgggcttggaggcatgcgcctgtagttcaagccactcaggaggctgaggtgagaggatcgcttgagcccaggagtttaagggtgtagtgaagccatgattgcaccagtgcgctccagcctgggtgacagagtgaaacccaccctgtctctttttgagacagagtctcactctcttgcccaggctggagtacaatggcgtgatctcagctcactgcaacctcctcctcccgggttcaagcgattcccctgcctcagcctcccgagtagctgggactacaggcatgtgccaccacacccggttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcatggctcactgcatcctctacctgccaggctaaagcagtcctcttgcctcagcctcctgagtagctgagactgcaggcgcatatgctgccttgcccagctaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttacaaatcattccccaaatatggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaatgctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagatattccgttccacaggccttccgctcaattcatagataatccgttccacaggccttccctcaactcatagataatccgttccacaggccttccgctcagctcacagataatccgttccacaagccttccgctcaattcgtagataatccattccacaggccttccgctcagttcatagataatccgttccacaggacttctgctcagttcgtagataatccgttccacaggccttccctcaactcatagataatctgttccacagtccttccgctcaattcatagataatccgttccacaggccttccctcaactcatagataatccattccacaggccttccactcaattcatagataatccgttccacaggccttaggctcaattcatagataatccgttccacagaccttgtgctcgattcatagataatctgttccacaggccttccctcaactcatagataatccgttccacaggccttccgctcatctcgtagataatccgttccacaggccttccgctcagctcatagataatccgttccacaggccctcccccaactcatagataatccattccacaggccttccgctcagctcatagataatccattccacaggccttccgctcagctcatagataatctgttccacaggccttctgctcagtttgtagataatccattccacaggccttccgctcaattcatagataatccgttccacaggccttccgctcagctcatagataatccattccacaggacttctgcttagctcatagataatccattccacaggccttccgctcaactcatagataatccgttccacaggccttccgctcagctcatagataatccattccacaggacttctgctcagctcatagataatccattccacaggccttccgctcagctcataatctgttccacaggccttccgctcagctcatagataatccgttccacaggccttccgctcagctcatagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggactaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaa

SEQ ID NO: 166 - DNA, 3391 bp, Homo sapiens
tttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaaca

SEQ ID NO: 167 - DNA, 8645 bp, Homo sapiens
ctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagtta

SEQ ID NO: 168 - DNA, 27801 bp, Homo sapiens
acattagatgctcaagtcttaggattgtggtttaacccggtagtgaaaattgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaacaccgcgtggccgtcatctgctccccgcggggttctgcacacgtagcagcgtttgggatgagcggggctgccagggctccaggccgcaccctcagccgctccaaagatccctccctcttttctgctcccagcctggttgggcagccacggtctgctccccaggagcctctgactcctctggtagtggcggcaggggctggagcctcagtttacttgttctgtaaatgcggagaacgccctgctcggcccccaccacaggcagccagtcattgctgagtgaggagggcttggcacacaaatgcaggctgctggggcagcggcctctgagccaacctgggagggaccccgagctgggaccgagggccggaagacaccgaggcagcgcctgcacccctgtgccattcccgtccccaccctcctgcacagatccacttgcttccgggcctcaagtgtgttctgttgagaaagggaaactgctttctctgtgtcggtctggggtagagcttgccaggagcaaagccagccctgcttcccgcgtccccactggcagggtccccatgtccctcagcctcagcttccttgtctgcaaggggtggagcggtcactggtgctctctgaccccagcaggccacaagtctgcagggaaggtcagggcagccggaacgcggccaggcaggtgcctgaaatgcagtcgggaccctgcctgcctcctggaaggatgtcggagccgcagctggtgggggccacggagtcactgcttctccttggtcccaaggggacgaccaagactcatggcttgacgctcccgtgggacgcggccacctgtgctcgagcctctgggccaaacatgggtccccagggtggatgcggtcactgcaggggccacacgggggatcagggagggtttcagctctgaggcccaaaccaggattccactttaagaccaaacccccacccgtgctcggagctccctgggcaggagtgagacggggcagctcggagcagccccacctcccaccagtcagtcccagagctgcgcccaccgggcaggacaggctgtgcgtcggggcatctttgcctctgcctggctggggtcagcacttgacctagagaaaagtcgggtggagaagaaggatagaatccatgagaacccatccagggataaatcgccacaaatgaactgcaaagaggtttctagaaagaggcctgtggctttgaaggccacaggggaggccccgctggctggactgacaaggtggcatcggccgagtgggctcctgaggggcagcctcgggccgggaaggagcggcttccctctggcccccggcctgacggctgtggaatgggcagagcttctccaaggctcgggagccagcaacactcatgcccacctggagggaccctgcccgcctgggccgagctcaccccacggatggacggccagccaggcaccttgccaggggccatgcacagggggccccatcccctgccgtccagagccgcccagctcgtctacgctggagcctccaggccctggtggtccctgagggtccctggcaggcccaccctgtgtctctggggctcttgttgaccggtgccagttatgggctcctcgggccacatcccatgaccctgcgccatcgtgggcatgatgccacttgctctggacacgccgggcaagggcctcttgttctccccaaaatcttggcagcacctgggcagaagttctgttgattgagggctgcagcctgaattcaggacttcaacctagtctaagaggtattgcaggcaactttcgcttcggtaccgtgagaaaatagtgacgggggaggccctggcctcagagggcagacgtcaggctcctgccggctcccttcggaaacgtccatctgccgccagcggccccgcgtgtgtgtgacggctctcgccagcctcgcccagcagcacgtggaccttccgcaggcagatgcgctttctccactcgggccgggacagatggccaccggctgctcacacggtcggggacccgcagcccaggcctccacgctggctccgggatgtccaggtgctggttgggctgaggatggtcgggcccagggctcggatctggccatcagcacagaagcccagttctgggaggcccaggcgtggatgctgacggctcgctaagcaggccaactcgtctgaccccgacgatgccagagccagctgagcagagctccaagaagcccgtggaacacagccccctgggccccaggagagccctgcactgcccactgcacggcctcacacggccacaggggccacagccgcacgctgggatcccaggctccagcccggcaccgcggcgtccctcagatcccggcctccagcccggcaccgcggtgtccgtcagatcccagcccggcaccgcagcgtccctcagatcccggcctccagcccggcaccgcggcgtccctcagatcccggcctccagcccggcactgcggcgtccgtcagatcacattggtgggtgccccccagtgctctcccataatgttccccagccggctgggagcctgctcctgcccaacctccatcctccccaagtcaagacggccaggagcaaaaacaggcaacggccagtctcagggacagagacgtggggaggcccccacagacacaggctacagtcaccagtgtcctcaggacacaaccctccgcctgggtttctgctctgcctccagacgaatcaggaacttctgtttcctagtattgttttcttagagttccgggggtgccagaagttataataaccactgtcccaaacaagcaaaaccaatggtgctaggaattgcaacacagaggcccagccaggcctgtcacgttggcgacctggcaccctccacaaccaggcatgtctggggtgtgcaagaggatgggaagacagagcacgtggtgcaagtgctggtgccctggggaggcaggagggatgtgccccttagagggaggagggatgtgcgccctggagggaggagggatgtgccccctggagggaggggtgatgtgccccgtggagggaggggggatgtgccccctggagggaggggggatgtgttccctggagggaggggggatgtgtcccgtggagggaggggggatgtgtcccgtggagggaggggggatgtgtcccctggagggaggggggatgtgtcccgtggggggaggggggatgtgtcccgtggggggaggagggatgtgtcccgtggagggaggggggatgtatcccgtggagggaggggggatgtgtcccctggagggaggggggacagccctgactctgggctggagaggaggaaggaggttgggcatgtgttttgcaggtggggtcctttgatgtggccgcgtcctgtgcacagcagatgcagcatcgccccctcctggacacccagcctcatgacaacacgaaatgtctccagaggttggccactgtcccctgggcccgggcacctctggggaaacactgctctaagcaagaaggaacgtttcgtcctacttcacgtaatacggcaaatatgaacatcagatttttaaatgccaacggaagcataaagcaaatgtacagccgggctaatcccagcacagcccatttgtaggagaagctccagccacagcccctgcctgcaaagcaagaagggtcacctgccccagggtcaaggactccacgaggggagagggggagggtccgctccatggtgcccttgtttcaagcacgttttctgcttactgaattccatcagttaaaaggtctaggaaacagaaaaggaagtggcgcgtgtcgccgtctgaggatctgctgacgggccccggcctcgtggaatcctcttctgcctctgtgggtctccagagtttcggaggcatctctgctcccaccgcggggtctggtggccacggggtccccaagtctgcaggaggagctgctctgtgtggcgagggtgatgaccatggctcttgttcactgagcagggccggtggccagcactgtccaagtcaccagtgcagccccataaggccatcttcacaacatccttggggcccgtttctcccactcccgtttccatggagatgtgattcacacagcaatagccacgcctcatgagtgcagagcatgggtcggtggtcagtccatccacggggccgtccacccatcactgccatctggctcccggacactcctcttcccacaagaactcgtgtccctgaccagtgactgcacctctccccatccagaacacgcttagaacacacttgcctccccgaaaagaactcgtatccctgaccagtgactgcacctctccccatccagaacacgctgcaaacacgcttgcctccccgaaaagaactcgtgtccctgaccagtaactgcacctctccccatccagaacacgctgcaaacacgcttgcctccccgaaaagaacccgtgtccctgagcagtgactgcatctctccccatacagaacacgctgcgaacacgcttgcctccccgaaaagaacccgtgtccctgagcagtgactgcacctcctttcccagtcggcttctgtctgtggacacgccttctctggacactgcatataaacagaacacagtcttcatgtctggtgtccttccctgagcactgtgtgttacagcctcagcacccgttagagcttccttcctctccgtggccgggtgacccgcgtgtggatgggccacgtcctctccctctctgtggctgggtgagacccgcgtgtggatggaccactgtagtattctgttttcacactgctaataaggacatacccgagactgggaaaaaaagaggtttaacgggacttacaattgcacatggttggggaggcctcagaatcacggtgggaggcaaaaggcacttcttacacggcaggagcaagagaaaatgaggaagaagcaaaagcggaaatcctgatcaaccagtcagatctcgtgagacttactcactatcacgagaatagcacgggaaagaccagccaccatgattcaattacctcccgctgggtccctcccacaacgcgcaggaattctgggaaatacaattcaagttgagatttgggtggggacacagcaaaaccatatcacccatgtcccttcctctctccgtggccggtgaccccatgtggacggaccgtcacccatgtcccttcctctctccgtggccggtgaccccacgtggacggaccgtcacccatgtcccttcctctctccgtggccggtgaccccacgtggacggaccgtcacccatgtcccttcctctctttgtggccgttggccccatgtggacggactgtgtccctcccccactcagtagttgcctctgcttgggagctcttgtgagcagtgctgctgtgtgaaatgtagaaactgaggcaggaggagactccctgtaacccaaggtcccaagctaataaggtggggccagtctcaacggacccctgcccagggcaatgctctgaccctgccctcctcagtcacaacctgcagctacactaggcccccacctctgagctgcaggagaagcctgtctcctgtgctgtcccagtgaggcagggagtgcaggtggggccacagcaccccaaaccccccagcaccccctgccccggggccacagcacccccaaaccccccagcaccccctgccccaccatcccctccaccccatctcccgcggcctccagggtctcactgacctcggctgtgcatgggaaccaagtgagggcgggattgggagcccatccctgcagaggaggctgggatcagaaggccccagcggagcccagagagggggttcatcagaccgtgactcaggctggcagagcttggtggccccagacaggatccgtccacatgagacaggtgcacctcgagagcagccgccgcccacactgcaggccaggcattggccggagccctgcgccaggtgggagctgccctgggacctgggggaccctccagccaccacgaaccttgagtcaaattgttcacattctttgtggctgggataaaggataaggacatttttgtggcaagaacaaaactgttgaccttggagttgaatatttttgaacagcttttgactctagacaagattaaaagtcgggaaagatcgatgttgtgtttgggggaagctggtgagtgcagcctcggggaagcactctgatgcccccacaccgcaccctgcgaccgagggctgacatgaggggaaggagggttattcctgtgactttgctggccagagctccagggggcatagactccctgcccagacctgcagttcagcttctctgctgttcgcacccctaggacaccaagaggtgctggtgcctgcaccaggcagcttcgggggcacagcccgagctccagggtgcccaggaaccgcccacacaagaccacggcaccatcggcgcccatagagccttccctgaggtaaagtgagagccctggggactcgggaaatccgtggcacacttttcttcccccacaggcgctcgtgagtgcatctcccggcgctccagaaacctcttggtctctgctgcttgttcagcttcttactcggagccaggcacccacagccctggaggaactgggcggtgatttccagacaggacgccgcacctccggctcgtgcccgacctcccggactggttcaaggccagtcagccctgagaggccaagaccacattctcctggacagcaagcttgtgaggctggattttataagataaaaatgacaagcagtggcgggttcacagaccagagctggctgcaggcctttcagaggcccgttagggcccctgggcccagccagccaccgttcatgtgtggatgtgcgctgtgggccttctgcccaggagcgctggacacaggatgagaccctccgtcgggcagagggaggctcccgggcagcggagggggcagaggctgtgtgagaccctccatcggacagagggaggctcccgggcagcagagggggcaggaggctgtgtctgcacgagtgtggctcccctccaccttatcttttttctcccagatccaggactgggcaggggagaaagtccccgctccacctcccaggtgggcactgttccgtgaagtaagctggagacctcagacccacacgggagaagagcggtacttgtttatcgtaggcacggggggctttgcagggagggacgtgaggccctgagagcggtgaggcctggaggcgccagcttccgaggggagagggagtgactggggaaccgtgagcggcccacagagcagagacggcgacttggtgtcttgtggcacgtctggggagcaatgggatcacctctcgcccgccctcccgccctgggagtccctggttccctgaggatctgacttcaggagttcagagaaagcctctccccacatccaacacttttcaagagacttcggctactttggggtggcgcatcctgaactcctgtcactggggcgcctgtgacccacccgggacccgtgacccactcgggacccgtgacccacccgggacccgtgacccacccggggcccgtgacccacccgggacccgtgacccacccgggacccgtgactcacccggggcctgtgactcacccggggcctgtgacccactcgggacctgtgacccacccgggatgcctgtgacccacccgggacctgtgacccactcaggacctgtgacccacctgagacctgtcctgtgacccacccggggcctgtgacccacccgggacctgctgcttcccaggcgtgctcacccgtctccccaggtgtgcccggcaggtgcatgctgggcccgcggggagctaagctggtttccacagggagtgctgcggccccagaccctgagccaaaggaccccgaaacaccgtcccccaccatcccagcggccaggggtcctgagacaaggtgcggtgagggagaagccgcggaaggacagcggaagcccaggcgccgtagctgggagacagctcaggggaagaccctcgtgccagtggcccaggcagatttgcatccggggctgggaaagacaaccgggcccctggattctaacaactcacaggcggttagacacagcgctgggcgttggagccgaagcgtccttcccttcctggcatacgtcaggagcacagcacgaggggcgggtggcttctgccctgcgcttctccaggacacagatgcacacacgaacgtgtaacgcacaacacatgtccacaaacaagaacacacaggcagggaggccggggctgcactgtctttgcaaaatcataataatagctaattaattaagggatgtgaaaacaccagaacaattgctctcagaggaggaggccgggtgggaactttcagcgccatttgatgtgagcagagcccaagccaaggtgtcaccagcctgggtctggagggccccactccctgcctggttccagcctccctcaccagtgtgcccagggaggaaaggaggggacagacttctggaacattctcccgggttctctaggaggttggccacagaagcgggatttctagaggctgccttttttttaaaaaaaaaaacaaacaagttatcttttactccacgcctctatcagggtgcgtaggggggtggcttctcccccgggggaaagtaggtgggtgcgtagcacggtggagcctggccgggaagcccagagccagagctgcttggagaagggggctgcaggtcctcagacgaagccagggcagaggagggcgcaactgggaagcggctgcagggctgcaataaacagagagggccctgggttagcaggtgagaccaccccgtgccggaccacagggaagcctgacatataccagggccactcacacgctccccacccaccccgccaacccagggccacccgcagactcagggccattcacatgggccccccgcagacccagggctattcacacaggccccctcagacctagggccactcacacagggccccccgcagacccagggctattcacacgggccccccacagacccagggctattcacacgggctcccacagacccagggccactctcacgcccctcccctcccccggagacccagggccactcttacgtccccctcccccaccgcagacccaggacctctctcaccggcccccaccccacagacccaggaccactctcaccggcccccccacaggcccaggcccactctcacgggcccccacagacccaggaccactgtcacgggcccccaccccacagacccaggacctctctcaccggccccccccacagatccaggacctctctcactggcccccaccccacagacccaggaccactctcacgggcccccaccccacagacccagggccaccagaaggagcagccccagcccggggcagaacaggagagggtggccggggcctcactggcacaaccttggcctccacagctgcatggggcagggggtggacgccccaggaagggtgtcctcagaccacatcccacttcctcacagccagcgagcctctgacctgactccaaaaccaacagttagggtccaccaggcctggggcccctgggctcacccaactcttcatatttgggaaaggccccacgtatgaaccccacacgtccacacgtccagcagcgtgtggctggttcagtgtcaccgtggctgactcagcggctcacacacgcatctgggtgttgccgtggaggcatcttcaggtgtgattgacacccttgcgtacagtgcctcagcccctggacacggacggcccctcctctccactgaaggcgttaaggaaagaggctgtggtccccaggagaagtggactctgccccagtggcctaggcactcccggggcagcgtcaccctccctggtctccagcctgccccctccctgtggttgtgcacctgaagcccacagtcatcagccagtcattcagaatcgatggattgatctctctcttcatatgtaggtacctgtattctcccataggctctgcttccctagagagccctgactaacacacatagacccacccaagtaattctgagaccagaaaagcgaagaacggcacagattttaaattgatacattctagtttttctccaactgctaacacacatcttaattcttttctttttttccccttaaattctagggggaacttctaatcaaattttaaataaataaagcaaacaaactccttctaagaaataacacaggaagagtttttcaaactccaagctaccagatgtgctctgtgctcctcttgccccagcctgcagggtcccatgagaagccagctgcctgtctgagcctgcgtgttcagcatccccagagaagccagctgcctgtctgagcctctccctggagagctctgcactgcagacgccctgggagctagcaggacctctggatcctgacagcagaatttctgcacaggtgtaggtaaggctgagaatggggcccttcctcagagggactgcaatgttgaggttgacagcccaggctcatgggatccagtggttcagggacacctgccaacctcatttctttcttcccccgaaactcacacaggtttctggccacaggcgacagagtgagacactagggaacattctctcaagtctgctgggagctcccaacttccaactctgtagcacccactcttcttcacagcagatgagcagttaaggaaactaaggggtaaaccccaggaccacagataaaccccaggaacccatggagtaactccctaggaaccaccgagtgaaccatggagtaaaactcaggaaccacggagtaaacccccaggaaccacggagtaaaactcaggaaccacggagtaaacccccaggaaccatggagtaaactctcaggaaccacggagtaaacccctccccccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacatccaggaaccacagagtaaactcccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacccccaggaccatggagtaaacatccaggaaccacagagtaaactcccaggaaccacagagtaacccctccccccaggaaccacagagttaagcccccgggaaccatggagtaaacccccaggaaccacagagtaaacccccaggaaacacagcataacctccccccaaaaaccacagagtaaaccccgaggaaccatggagtaaagccccaggaaccagagtaatctccccaggaaccacagaggtaaacccccagaaaccacagcataaatccccaagaaccacagagtaaacccccaggaaccatggagcaaacccccaggaaccacagcataaatccccaagaaccaaggagtaaacccccaggaaccacggagtaaacccccaggaaacatggagtaaccccccccccaggaaccacagagttacaccgccagaaaccacagagttaaaccccaaagaaccacggagtaaacccccaggaaccacagaacaaacccctaggagccacgaagtaaacccccagtaaccacagagttaaaccctcaggaatcacagagtaaccacccaggaaccacggaataaatacccctggaaccatggagtaaactcccaggaaccacggagtaaacaccccaggaaccatggagtaaaccccccaggaccacaaagtaaacccccaggaacatggagtaaaccgccaggaaccatggaataaacccccaggaaccacagagtaaaccctgggaccacggggttaaccactgaatgacagggcccccctagggacaagccctgcccacgagtaatctcacaggggaagggagggcatgtttcttagtaacggggcaggaactcatcttctgctgtgatgccacgtcctcccctgcacttcatgcctggcaaagctgc

SEQ ID NO: 169 - DNA, 26118 bp, Homo sapiens
gatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaacaccgcgtggccgtcatctgctccccgcggggttctgcacacgtagcagcgtttgggatgagcggggctgccagggctccaggccgcaccctcagccgctccaaagatccctccctcttttctgctcccagcctggttgggcagccacggtctgctccccaggagcctctgactcctctggtagtggcggcaggggctggagcctcagtttacttgttctgtaaatgcggagaacgccctgctcggcccccaccacaggcagccagtcattgctgagtgaggagggcttggcacacaaatgcaggctgctggggcagcggcctctgagccaacctgggagggaccccgagctgggaccgagggccggaagacaccgaggcagcgcctgcacccctgtgccattcccgtccccaccctcctgcacagatccacttgcttccgggcctcaagtgtgttctgttgagaaagggaaactgctttctctgtgtcggtctggggtagagcttgccaggagcaaagccagccctgcttcccgcgtccccactggcagggtccccatgtccctcagcctcagcttccttgtctgcaaggggtggagcggtcactggtgctctctgaccccagcaggccacaagtctgcagggaaggtcagggcagccggaacgcggccaggcaggtgcctgaaatgcagtcgggaccctgcctgcctcctggaaggatgtcggagccgcagctggtgggggccacggagtcactgcttctccttggtcccaaggggacgaccaagactcatggcttgacgctcccgtgggacgcggccacctgtgctcgagcctctgggccaaacatgggtccccagggtggatgcggtcactgcaggggccacacgggggatcagggagggtttcagctctgaggcccaaaccaggattccactttaagaccaaacccccacccgtgctcggagctccctgggcaggagtgagacggggcagctcggagcagccccacctcccaccagtcagtcccagagctgcgcccaccgggcaggacaggctgtgcgtcggggcatctttgcctctgcctggctggggtcagcacttgacctagagaaaagtcgggtggagaagaaggatagaatccatgagaacccatccagggataaatcgccacaaatgaactgcaaagaggtttctagaaagaggcctgtggctttgaaggccacaggggaggccccgctggctggactgacaaggtggcatcggccgagtgggctcctgaggggcagcctcgggccgggaaggagcggcttccctctggcccccggcctgacggctgtggaatgggcagagcttctccaaggctcgggagccagcaacactcatgcccacctggagggaccctgcccgcctgggccgagctcaccccacggatggacggccagccaggcaccttgccaggggccatgcacagggggccccatcccctgccgtccagagccgcccagctcgtctacgctggagcctccaggccctggtggtccctgagggtccctggcaggcccaccctgtgtctctggggctcttgttgaccggtgccagttatgggctcctcgggccacatcccatgaccctgcgccatcgtgggcatgatgccacttgctctggacacgccgggcaagggcctcttgttctccccaaaatcttggcagcacctgggcagaagttctgttgattgagggctgcagcctgaattcaggacttcaacctagtctaagaggtattgcaggcaactttcgcttcggtaccgtgagaaaatagtgacgggggaggccctggcctcagagggcagacgtcaggctcctgccggctcccttcggaaacgtccatctgccgccagcggccccgcgtgtgtgtgacggctctcgccagcctcgcccagcagcacgtggaccttccgcaggcagatgcgctttctccactcgggccgggacagatggccaccggctgctcacacggtcggggacccgcagcccaggcctccacgctggctccgggatgtccaggtgctggttgggctgaggatggtcgggcccagggctcggatctggccatcagcacagaagcccagttctgggaggcccaggcgtggatgctgacggctcgctaagcaggccaactcgtctgaccccgacgatgccagagccagctgagcagagctccaagaagcccgtggaacacagccccctgggccccaggagagccctgcactgcccactgcacggcctcacacggccacaggggccacagccgcacgctgggatcccaggctccagcccggcaccgcggcgtccctcagatcccggcctccagcccggcaccgcggtgtccgtcagatcccagcccggcaccgcagcgtccctcagatcccggcctccagcccggcaccgcggcgtccctcagatcccggcctccagcccggcactgcggcgtccgtcagatcacattggtgggtgccccccagtgctctcccataatgttccccagccggctgggagcctgctcctgcccaacctccatcctccccaagtcaagacggccaggagcaaaaacaggcaacggccagtctcagggacagagacgtggggaggcccccacagacacaggctacagtcaccagtgtcctcaggacacaaccctccgcctgggtttctgctctgcctccagacgaatcaggaacttctgtttcctagtattgttttcttagagttccgggggtgccagaagttataataaccactgtcccaaacaagcaaaaccaatggtgctaggaattgcaacacagaggcccagccaggcctgtcacgttggcgacctggcaccctccacaaccaggcatgtctggggtgtgcaagaggatgggaagacagagcacgtggtgcaagtgctggtgccctggggaggcaggagggatgtgccccttagagggaggagggatgtgcgccctggagggaggagggatgtgccccctggagggaggggtgatgtgccccgtggagggaggggggatgtgccccctggagggaggggggatgtgttccctggagggaggggggatgtgtcccgtggagggaggggggatgtgtcccgtggagggaggggggatgtgtcccctggagggaggggggatgtgtcccgtggggggaggggggatgtgtcccgtggggggaggagggatgtgtcccgtggagggaggggggatgtatcccgtggagggaggggggatgtgtcccctggagggaggggggacagccctgactctgggctggagaggaggaaggaggttgggcatgtgttttgcaggtggggtcctttgatgtggccgcgtcctgtgcacagcagatgcagcatcgccccctcctggacacccagcctcatgacaacacgaaatgtctccagaggttggccactgtcccctgggcccgggcacctctggggaaacactgctctaagcaagaaggaacgtttcgtcctacttcacgtaatacggcaaatatgaacatcagatttttaaatgccaacggaagcataaagcaaatgtacagccgggctaatcccagcacagcccatttgtaggagaagctccagccacagcccctgcctgcaaagcaagaagggtcacctgccccagggtcaaggactccacgaggggagagggggagggtccgctccatggtgcccttgtttcaagcacgttttctgcttactgaattccatcagttaaaaggtctaggaaacagaaaaggaagtggcgcgtgtcgccgtctgaggatctgctgacgggccccggcctcgtggaatcctcttctgcctctgtgggtctccagagtttcggaggcatctctgctcccaccgcggggtctggtggccacggggtccccaagtctgcaggaggagctgctctgtgtggcgagggtgatgaccatggctcttgttcactgagcagggccggtggccagcactgtccaagtcaccagtgcagccccataaggccatcttcacaacatccttggggcccgtttctcccactcccgtttccatggagatgtgattcacacagcaatagccacgcctcatgagtgcagagcatgggtcggtggtcagtccatccacggggccgtccacccatcactgccatctggctcccggacactcctcttcccacaagaactcgtgtccctgaccagtgactgcacctctccccatccagaacacgcttagaacacacttgcctccccgaaaagaactcgtatccctgaccagtgactgcacctctccccatccagaacacgctgcaaacacgcttgcctccccgaaaagaactcgtgtccctgaccagtaactgcacctctccccatccagaacacgctgcaaacacgcttgcctccccgaaaagaacccgtgtccctgagcagtgactgcatctctccccatacagaacacgctgcgaacacgcttgcctccccgaaaagaacccgtgtccctgagcagtgactgcacctcctttcccagtcggcttctgtctgtggacacgccttctctggacactgcatataaacagaacacagtcttcatgtctggtgtccttccctgagcactgtgtgttacagcctcagcacccgttagagcttccttcctctccgtggccgggtgacccgcgtgtggatgggccacgtcctctccctctctgtggctgggtgagacccgcgtgtggatggaccactgtagtattctgttttcacactgctaataaggacatacccgagactgggaaaaaaagaggtttaacgggacttacaattgcacatggttggggaggcctcagaatcacggtgggaggcaaaaggcacttcttacacggcaggagcaagagaaaatgaggaagaagcaaaagcggaaatcctgatcaaccagtcagatctcgtgagacttactcactatcacgagaatagcacgggaaagaccagccaccatgattcaattacctcccgctgggtccctcccacaacgcgcaggaattctgggaaatacaattcaagttgagatttgggtggggacacagcaaaaccatatcacccatgtcccttcctctctccgtggccggtgaccccatgtggacggaccgtcacccatgtcccttcctctctccgtggccggtgaccccacgtggacggaccgtcacccatgtcccttcctctctccgtggccggtgaccccacgtggacggaccgtcacccatgtcccttcctctctttgtggccgttggccccatgtggacggactgtgtccctcccccactcagtagttgcctctgcttgggagctcttgtgagcagtgctgctgtgtgaaatgtagaaactgaggcaggaggagactccctgtaacccaaggtcccaagctaataaggtggggccagtctcaacggacccctgcccagggcaatgctctgaccctgccctcctcagtcacaacctgcagctacactaggcccccacctctgagctgcaggagaagcctgtctcctgtgctgtcccagtgaggcagggagtgcaggtggggccacagcaccccaaaccccccagcaccccctgccccggggccacagcacccccaaaccccccagcaccccctgccccaccatcccctccaccccatctcccgcggcctccagggtctcactgacctcggctgtgcatgggaaccaagtgagggcgggattgggagcccatccctgcagaggaggctgggatcagaaggccccagcggagcccagagagggggttcatcagaccgtgactcaggctggcagagcttggtggccccagacaggatccgtccacatgagacaggtgcacctcgagagcagccgccgcccacactgcaggccaggcattggccggagccctgcgccaggtgggagctgccctgggacctgggggaccctccagccaccacgaaccttgagtcaaattgttcacattctttgtggctgggataaaggataaggacatttttgtggcaagaacaaaactgttgaccttggagttgaatatttttgaacagcttttgactctagacaagattaaaagtcgggaaagatcgatgttgtgtttgggggaagctggtgagtgcagcctcggggaagcactctgatgcccccacaccgcaccctgcgaccgagggctgacatgaggggaaggagggttattcctgtgactttgctggccagagctccagggggcatagactccctgcccagacctgcagttcagcttctctgctgttcgcacccctaggacaccaagaggtgctggtgcctgcaccaggcagcttcgggggcacagcccgagctccagggtgcccaggaaccgcccacacaagaccacggcaccatcggcgcccatagagccttccctgaggtaaagtgagagccctggggactcgggaaatccgtggcacacttttcttcccccacaggcgctcgtgagtgcatctcccggcgctccagaaacctcttggtctctgctgcttgttcagcttcttactcggagccaggcacccacagccctggaggaactgggcggtgatttccagacaggacgccgcacctccggctcgtgcccgacctcccggactggttcaaggccagtcagccctgagaggccaagaccacattctcctggacagcaagcttgtgaggctggattttataagataaaaatgacaagcagtggcgggttcacagaccagagctggctgcaggcctttcagaggcccgttagggcccctgggcccagccagccaccgttcatgtgtggatgtgcgctgtgggccttctgcccaggagcgctggacacaggatgagaccctccgtcgggcagagggaggctcccgggcagcggagggggcagaggctgtgtgagaccctccatcggacagagggaggctcccgggcagcagagggggcaggaggctgtgtctgcacgagtgtggctcccctccaccttatcttttttctcccagatccaggactgggcaggggagaaagtccccgctccacctcccaggtgggcactgttccgtgaagtaagctggagacctcagacccacacgggagaagagcggtacttgtttatcgtaggcacggggggctttgcagggagggacgtgaggccctgagagcggtgaggcctggaggcgccagcttccgaggggagagggagtgactggggaaccgtgagcggcccacagagcagagacggcgacttggtgtcttgtggcacgtctggggagcaatgggatcacctctcgcccgccctcccgccctgggagtccctggttccctgaggatctgacttcaggagttcagagaaagcctctccccacatccaacacttttcaagagacttcggctactttggggtggcgcatcctgaactcctgtcactggggcgcctgtgacccacccgggacccgtgacccactcgggacccgtgacccacccgggacccgtgacccacccggggcccgtgacccacccgggacccgtgacccacccgggacccgtgactcacccggggcctgtgactcacccggggcctgtgacccactcgggacctgtgacccacccgggatgcctgtgacccacccgggacctgtgacccactcaggacctgtgacccacctgagacctgtcctgtgacccacccggggcctgtgacccacccgggacctgctgcttcccaggcgtgctcacccgtctccccaggtgtgcccggcaggtgcatgctgggcccgcggggagctaagctggtttccacagggagtgctgcggccccagaccctgagccaaaggaccccgaaacaccgtcccccaccatcccagcggccaggggtcctgagacaaggtgcggtgagggagaagccgcggaaggacagcggaagcccaggcgccgtagctgggagacagctcaggggaagaccctcgtgccagtggcccaggcagatttgcatccggggctgggaaagacaaccgggcccctggattctaacaactcacaggcggttagacacagcgctgggcgttggagccgaagcgtccttcccttcctggcatacgtcaggagcacagcacgaggggcgggtggcttctgccctgcgcttctccaggacacagatgcacacacgaacgtgtaacgcacaacacatgtccacaaacaagaacacacaggcagggaggccggggctgcactgtctttgcaaaatcataataatagctaattaattaagggatgtgaaaacaccagaacaattgctctcagaggaggaggccgggtgggaactttcagcgccatttgatgtgagcagagcccaagccaaggtgtcaccagcctgggtctggagggccccactccctgcctggttccagcctccctcaccagtgtgcccagggaggaaaggaggggacagacttctggaacattctcccgggttctctaggaggttggccacagaagcgggatttctagaggctgccttttttttaaaaaaaaaaacaaacaagttatcttttactccacgcctctatcagggtgcgtaggggggtggcttctcccccgggggaaagtaggtgggtgcgtagcacggtggagcctggccgggaagcccagagccagagctgcttggagaagggggctgcaggtcctcagacgaagccagggcagaggagggcgcaactgggaagcggctgcagggctgcaataaacagagagggccctgggttagcaggtgagaccaccccgtgccggaccacagggaagcctgacatataccagggccactcacacgctccccacccaccccgccaacccagggccacccgcagactcagggccattcacatgggccccccgcagacccagggctattcacacaggccccctcagacctagggccactcacacagggccccccgcagacccagggctattcacacgggccccccacagacccagggctattcacacgggctcccacagacccagggccactctcacgcccctcccctcccccggagacccagggccactcttacgtccccctcccccaccgcagacccaggacctctctcaccggcccccaccccacagacccaggaccactctcaccggcccccccacaggcccaggcccactctcacgggcccccacagacccaggaccactgtcacgggcccccaccccacagacccaggacctctctcaccggccccccccacagatccaggacctctctcactggcccccaccccacagacccaggaccactctcacgggcccccaccccacagacccagggccaccagaaggagcagccccagcccggggcagaacaggagagggtggccggggcctcactggcacaaccttggcctccacagctgcatggggcagggggtggacgccccaggaagggtgtcctcagaccacatcccacttcctcacagccagcgagcctctgacctgactccaaaaccaacagttagggtccaccaggcctggggcccctgggctcacccaactcttcatatttgggaaaggccccacgtatgaaccccacacgtccacacgtccagcagcgtgtggctggttcagtgtcaccgtggctgactcagcggctcacacacgcatctgggtgttgccgtggaggcatcttcaggtgtgattgacacccttgcgtacagtgcctcagcccctggacacggacggcccctcctctccactgaaggcgttaaggaaagaggctgtggtccccaggagaagtggactctgccccagtggcctaggcactcccggggcagcgtcaccctccctggtctccagcctgccccctccctgtggttgtgcacctgaagcccacagtcatcagccagtcattcagaatcgatggattgatctctctcttcatatgtaggtacctgtattctcccataggctctgcttccctagagagccctgactaacacacatagacccacccaagtaattctgagaccagaaaagcgaagaacggcacagattttaaattgatacattctagtttttctccaactgctaacacacatcttaattcttttctttttttccccttaaattctagggggaacttctaatcaaattttaaataaataaagcaaacaaactccttctaagaaataacacaggaagagtttttcaaactccaagctaccagatgtgctctgtgctcctcttgccccagcctgcagggtcccatgagaagccagctgcctgtctgagcctgcgtgttcagcatccccagagaagccagctgcctgtctgagcctctccctggagagctctgcactgcagacgccctgggagctagcaggacctctggatcctgacagcagaatttctgcacaggtgtaggtaaggctgagaatggggcccttcctcagagggactgcaatgttgaggttgacagcccaggctcatgggatccagtggttcagggacacctgccaacctcatttctttcttcccccgaaactcacacaggtttctggccacaggcgacagagtgagacactagggaacattctctcaagtctgctgggagctcccaacttccaactctgtagcacccactcttcttcacagcagatgagcagttaaggaaactaaggggtaaaccccaggaccacagataaaccccaggaacccatggagtaactccctaggaaccaccgagtgaaccatggagtaaaactcaggaaccacggagtaaacccccaggaaccacggagtaaaactcaggaaccacggagtaaacccccaggaaccatggagtaaactctcaggaaccacggagtaaacccctccccccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacatccaggaaccacagagtaaactcccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacccccaggaccatggagtaaacatccaggaaccacagagtaaactcccaggaaccacagagtaacccctccccccaggaaccacagagttaagcccccgggaaccatggagtaaacccccaggaaccacagagtaaacccccaggaaacacagcataacctccccccaaaaaccacagagtaaaccccgaggaaccatggagtaaagccccaggaaccagagtaatctccccaggaaccacagaggtaaacccccagaaaccacagcataaatccccaagaaccacagagtaaacccccaggaaccatggagcaaacccccaggaaccacagcataaatccccaagaaccaaggagtaaacccccaggaaccacggagtaaacccccaggaaacatggagtaaccccccccccaggaaccacagagttacaccgccagaaaccacagagttaaaccccaaagaaccacggagtaaacccccaggaaccacagaacaaacccctaggagccacgaagtaaacccccagtaaccacagagttaaaccctcaggaatcacagagtaaccacccaggaaccacggaataaatacccctggaaccatggagtaaactcccaggaaccacggagtaaacaccccaggaaccatggagtaaaccccccaggaccacaaagtaaacccccaggaacatggagtaaaccgccaggaaccatggaataaacccccaggaaccacagagtaaaccctgggaccacggggttaaccactgaatgacagggcccccctagggacaagccctgcccacgagtaatctcacaggggaagggagggcatgtttcttagtaacggggcaggaactcatcttctgctgtgatgccacgtcctcccctgcacttcatgcctggcaaagctgc

SEQ ID NO: 170 - DNA, 47874 bp, Homo sapiens
agcaaaggtctaaagatagtagtgcagtctgtaattctgtaagtggatatattggaaccataacaacagcaacagctaacatttattaagtgctcattatttattagatacagtattatgtatcatctgttattcatgtgtaaggcaggtagtgtctttattcccattttggagatgaagaaatcaaggtatacagtagttaagaaacttacttaaggtcatacgatctgtgctagctttcagattcagggaacttgacttcagaaaccatactcttaaccagtatgccaaaccaccttctatgaatttgaaaccacctcccatgaattgatgaattcataattcatcagttggtgttaatggaagtggtggaatatagccctgaggccaagttctaaattgtttaggaagtgacccaaatactgagataatcataacaaaaaaagaggagagaaaagaaaaaaaaggaaggaagggagggagggagagaaagaaaaagtccattccaacaggcactgggtattggatattatgggagtctcccataaagtataaggggcccataaccaggggactgagacttcacagtaaggaacccagccagtagaaactgggatacagggcaaggaaactttccagtaacagtggactggaataaaatcagagcaaaatcagagataaaataattcaaagtagaggcagcatttcttgacaaaagatttcttatgttatctcccctactgagggctgaagttggccccagagtgagatgcatagttataagtcagggttaatgtaatagattcagctcagaggcaaacagaagcaagggcaccgagccaggtaggccattacaaaatggcccaactgggttagagttccaggcaagagacttattttcctaactttactaacattatttctccattgtggcagctcccgcttctgtgggacatggcatcatgtagcagtgacattagatacccaaagactgtggaacagggagatgaagtttcataacataattacaaaatttaacagcaccctttcacatattttatggcccaatctatgttgttattcttttattattttttaagaaatgtagtatgttatgtaatatactgattgcagagttcacgaagccatttgggagattactgggaggaataatttgatatgaaattattatttaattatatcactttcttattctgtcttatactaacttttgcagaatgtatattatttggagagccttgtttgatatccttaacagacagagtaaacattcaagatagtacttttaggagagtagtttgaatagttttcatttgctaattccatcctcttttttctgtgaaagagaaaaacaaaaacattttattttgttttctttcatgtagtgtttatccattgcctccatattttataacagcaccaaagactagtttttctgttctgtttaaagctcatagtttcttagaactagttgtaaatactgttaagagtcccccaaacagttttttaagaacctaatttagtttcatttgtactaagaagctgttttctagatgactaacatcatatagtgttgtttccatcaaaaatattagtctggcatttgtcatgttctgtccactaaatagctttgttattattgaggtctaagctctgattttttatcttatccaaattcctaccttaggggtctagggagtcatgtcctacaaaccataaattctcatgagatgggttttatttgaccctatatattgtgacttacttttcagtctgactctggcataacattatgagacaaggaaaaaatatttaaccccaaaatatatttccttgttataccttgaaattgccctgcaaagtttcttgtgggaaaaatccacattctatagagaatccccttccccttttgttttccttcctttctttccagatacaggagttaatcaactaagaggtaggcacccttttaagtcccaaaagaaacaatttacaacccccgctctctctgaagtctgctatctgagagcttcctctgcacaataaaagttggtctccacaatcctttaccttttttttgtttcgttttttgtttttttgagacggagttttgctcttgttgcccaagctggagtccaatggcgtgatctcgactcaccacagcctccgcctcttgggttcaagcaattctcctgcctcagccgcccgagtagctgggcgccaccacacccggctatgcgcctggccacacccggctaattttgtatttttagtagagacggggtttctccatgttggtcaggctggtcttgaacttccaacctcaggtgatttgcccacctcggcctcccaaagtgctgggattacaggcatgagccactgtgcctgcctcaatcctttatctttaacctgaacattcctttctgtcgatccaagtctttagacaaactccaccaattgtcaaccagaagatgttggaatttatttaaagcctggaagccccgctttgagttgtcccacctttctaaatcaaaccaatgtatttctttcttttcttttttttttttttttttgagtcaaagtcttgctcttgtcccccaggctggagtgcaatggcacaatctcggctcactgcaacctctgcctcccggattcaagcgattctcttgcctcagcctcccgagtagctgggattacaggcgcctgccaccacgcccagctaatttttgtatttttagtagagacggggtttcaccatgttgaccaggctggtcttaaactcctgacctcaggtgatctgcctgcctcggcctcccaaagtgctgggattacaaatgtggagccaccgcgcccggccaaaccaatgtgtttcttaaatgtatttgattaatgtctcatgccttcctaaaatacatgacaacaagctgtaccctgaccaccttgggcacacgttctcaggacctcctgagagctgtgtcacaggctgtggtcactcatatttggctcagaataaatctcttaaaatattttacagagtttgactcttttcgtcaatattatgaaatgtgtctgagatacatatacaaaagaaaaatactaagatatagcatgcatccaagaaatgcagtatctttctgttaacataaattatctaaattcatataattcatgtgcatttctgagtctcatctcacatcagacaggcagcctgagatgaagaatgagcacgggctcaggttgggacctggtaaaagcaggcatcaccatttaaggagcagagacctctgctaggttgtttcacctctctgagtttgtttcctcatgtatcagttgggaatgatatcgaatttgtatcatccttatgaaaaaacaaatatatatgaagttgcaaatataggttttcaacaaaagttaacagctatcactcattggcatctagactttaagatgattccactcaagagagcgacataattctaaataagaaaatgcttttgatgtaagagtccatttcctgcctctcgggcacgccaccacagcctgaggctccattagctgttgctatctgcagttagtgatttagcttggagcatatcgggcgctgtactaagtgatctacatatgttatttcatttaataacagcaatcctttcaggaaattttggtttctgactttctaccatgactttgacctatgtacattttcttttagactatgtattcttttgacttttgtctgccttattctagccattgctttgcacaaattatggcactttatgtcatcaaaccatattagttaggaggctgtgggatgcaaataacagagaaccagacttgatctgtcaaaaaataaagggaatttttttcatatacacaactggataattcttcaccgggttctatctctgtgattcttttcactctgtcttcctccatggctctgcttgttgtatcagaaatggctgcagcagttcctgacatgacatctttgtactacactctccagaggaatggagagttgctgttttcccagaaagaagctcttggcttccttcgacaggaccagtgtaggtcttgtgctacctctgacaccatcacttagaccaggggcttggggtcattgactggcttatccctgctcttccctgagtcaatcaacggacaagaggaatggtgttacattgcttagtttagacctacacccgaggttgtggtccatgtcacccaaatcgcatgggcatcatggagcaggaggtgaaatgggtacaggaaggccgtcttgcccccagtgtcaaaggaaatgggtattagtccattttcacactgttataaagagctgcttgagactgggtaatttataaattaaagaggtttaattgactcacagttctgcatggctggggaggcctcaggaaacgtacaatcatggcagaaggcaaagggaaagcaaggcatgtcttacatggcggcaagagagggagagcaaagggggaagtgccacacttttaaaccatcagatctcatgagaactcatttactatcacaggaacagcaagggggaaatccgcccccaagatgcagtcacctcccaccaggcccctcccttgacatatagggattacaattcgagatgagatttgggtggggacacacagccaagccctatcagaatggttacaacatttcacttttaattatgacatgttgctagagggtttcttttaaaatttttttatcagtttaaggaagtcatcttcacaattaagtttttttttttaatcatgaatggaagttgactttcatcaaatgttttttctaaatctgttgagatgatcatgtggatttttttctttattctattaatgtgataagttacactcatttttaaaaacaactttagctataatggcatataataaactgcacatatttaaagtatatagtttgatagcttttgacatatgtgtatacctgtgaaactatcaccataatcaaaataatgaacatatgtatcattcccttccaaactttttttttttttttttttgagacagggtctcacactgtggcccaagctggagtgcagtggctcactgcaacctctacttccctgggctcatgtgattctccagctttagcctcctatgtagctgggactacaggcatgagccaccacacctggctaacctggctaatttttgcattttttgtagaaatggggtttcaccatttcctcaggttggtcttgaactcctgagctcaaagtgatctgcccaccttggcctcccaaagtgctgggattacaggtgtgagccaacatgcctggccccaaacattttcttatccctcctgtaatccctgtctccagccccttccctcctacccctgctccacacctgatctactttctgtcactacagattagttgcattactaattgaagttttgaaggttaaattaactttccatttctgaaataaaccagtttgatcattatgtattagctctctctcttacattaagggaacttcaaaaaggtcacgggaaaatggaattaaaagataaaaagaaaaaatataaactttatttttcaacataagctctgtcaagtttaagacacttttataagtgacaatgtcagccatttagtccatccctaaagaactgagggtcctgggatttaaccatgtcagtgcagtctttttcacattagtaactgaagaaaagtgggtgccctttaatgatttattaagattagggaacaaaaagaagtcagaaggagccaaatcaggtctgtaggtggttgcctaatgattttcccgttgaaactctggcaaaattgtccttgtttgatgataggaataagaggagtattgtcatggtggagaaggaccccctgttgaagctttcctgggcatttttgtgctaagcttttggctttctcaaaacactctcattgtaaacggattttatcattctttggctctccagaaagtcaacaagcaaaatgctttgagcattctcaaaaactgttgccatgacctttgctcatcactaatccacttttgctttgatgggccacctctacatcttggtagccattgctttgattgtgctttgtcttcatgatcatactggtaaagccatgattcatctctttacaattctttgaagaaatgctttgggatcttgatcccacttgtttgcaacatccattgaatgctctgcttttgtctgcagctgatacgaagtgcaatggttttggcacctaccaagtggaaaatttgctcaactttaatttttcagtcagaattgtgtaagctgaaccaattgagatgtctgtggtgttggctgttattttttcggttaatcattggccctcttcaattaaggcatgaacaagattaattttttccttaaaaattgatgcagatggtctgcccactgtgggcttcatcttcaacattgtctcatcccttcttaaaatgagttatccatttgtacactactgatttctttgggggattgaccccacaaagtttttgtaaagcatcagggtttagccattcttccacccaagcttcaccataaatttaatgttcttgtttcaattttagcagaattcatgttcctctgatggggctcttttcaaactgatgtcttatccttcttagtgcctcaaactagatcctgttcagacattttatgacaagttagcataagtttattctgatgcaaaaaacccctgaaatctatgcataggtttttcaaaatacacattttccataaactttttgaagacccctattatttctgtatttgtttaaccaacattttgcttctatgtttataaatgagattggggtgtaagttttctttctagtaatgcccttctcatactttagtatcaaggttatgctagccttgtaagatgagctgaggatggggagaatgtttcctattctctgttttattctctggaagaatttatataagacaggtttttttttttaattaagttttggtttgaatcaaccagtgaaacctcctagactcacaagttttttttgttctgttttgttttgttttgagatggagtctcgctctgtcacccaggctggagtccagtggcgcaatctcggctcactgcaagctccgcctcccgggttcacaccattctcctgcctcagcctccagagtagctgggactataggcgcccaccaccatgcctggctaaatttttttgtatttttagtagaggcagggtttcaccatgttagccaggatggtctcgatctcctaacctcgtgatctgcctgccttggcctcccaaagtactgggattacaggcgtgagccaccgcgcctggccaacctatagggttttttttggaaagctttaagttattaattcaattttaaaataaataaggggttgttcacagttttcttcttgtgctgttagtttttataaaaggtatgttttcttgactttttaattgactgtatgcacgtaatatgcatgcagcatgagcaatgagagtgagaccctgtctcaaaaccaaccaaccaacaacaacaataaaactctataagctctgtagtgacgtttcctcttttatttctgatattggttatttaagcttgctttctgtatttcttcattattctccatgggggtttataaatttattcatcatttgaaagaaccaacttttacccttattgatcttctctattgtatttttgttttctgttttacttgttgctgttatctttttatttccttccttatattttctttagatttctggaattttttttgtttgttttttgttttttgagacagggtctcaccatgttgcccaggctggtctccaactcctgggctcaagtgatcctccttccttggcctcccaaagtgctgggattactaaataggtgtgagccactgtgcccagcctattttatttagatttaagttgttcttttcataactttttatcaaggatgtttagcttattgcttttcagcttttcttcttctctaatatatgaatttgggggccataaactttactcgtagaatagttttaatggtgcacctcataaattttaaagaacatttacttcaaaatgggctctaatttccactgtgacttttttctttggcctatgggttattagaaagtatatttcttaatttataagcattgtgaattttctaggtaaatttttgttattgatttctagtctaatttctttatggtaaaataatttgttttgtataaattcaattctttggaatttgtggcaatttgctttcacatatgattttgataatgatctatgcatatttgaagccaatgtgtatattctgatgtttcaaggtagagtattgtatttgtgactattaggtcaaatacgtaaaaagtattgttcaaattttacatatcgttataaattatctgatatacctgagagaggtatgttcagatttctcactatgatttttaaatttctctgttttgtcaatgttgtttaatatataattttgagctatgttactaggtgaattaaaatgtagaagtattatctcttaatagagaagttaaagttttatcattttgaaatgcagttgtccctccatatccataggttccatatctgtggattcaattggggatcaaaaatatttgggaaaaaattgcatctgtactgaacacatacagactttttgtcttgtcattattccctaaacaatacagtatgacaactatttatatagcatgtatattgtattaggtattataagtaatctagagatgatttaaaacacatgggaatacattatatgcaaatactattctgtcttatgtcagggacttgactatccatggattttggtatccataggaggtcttggaatcaatcccacatggatacctgaaggccttctttgtctgatataaatatagcttatatgctattggcacatgttttcattttatatatacttaaaatctcctaatgtattattataactattgctatatttggttaaaaatttaggtttatccacgtttgcccttttcattgttctttatgccttcctgcatctttgagcttccatctgggagcggaatacacccttcagtgttgtctttaggttagactatcgatacaaattctctacatgaagtgaaaaatgttttttttctctacttcattattgaggagtaattttactggtagagaattttaggtttatagctatattccttcggcactttgaagataattccattttattctggcttctcttgattctttcaagaagtcagctgtcagtctgatacttgcacctttgatgttaatctgtcttttctctcaggtttcttttaatatgtcttctataacttttatttttagcattttttactatgttgtgcttttctttttccttatcttggtttaagtttggagatctacttgaatctgtgcttttggccaatttttgcaaagtctcagtcattatcttcttgaatatgcctctttcccattctctcttccctctcttctggataccttctatctatctaactttctggacatgcatgaatgggccccggcaacctatctgaccccatcccctgccgtactctcgttactcgcttgtctctatcttgctgtttttctaacatgccaagcatgcttcttactcctagatttttaaaaatattgcttccttagcctggaacactgttttcaagatatgtctaagactcattcccttacatgattcaggtctctgctcaaatgtggccttatcagagaggctttctctgacatttattcaaaattatcatccagacctctcctctcccatattgttctctaactctttacctggttttatgcttcttcatagcacttactacaatatgacacattatatatccaatatttatttgcttattctttgtctctctccatttgaatagaaattctgaagttctgtaagaggagagagctttttcccaccccctcctcacagttgtatcccatcccctggaatagtgcctggattagagtaaatgttcaataaatatttgtaggagaatgaatgaatgattaatagatagaagatataggaagagttctctacaggaagtaaagaaagtggagaaggcagaataacaaactaagtaagtcttttaatttgtatggtctatattttaatctttcgaatgtaaagatagtatcattgatcatatttctgttcatcaatgttacctaaaatagcaaaatgaaatattaatatgtttgaagatatagctttcattagtttaaattaactatctcatttagtttaggcatatggtccacaaatttttaagaacatttaattttaatttaaaaaattaagcctaccaaataagatgcattattttccagtgacttaatatgtatattcaagactttttcaattttttatagtataaaattattgtgattgcacatgaaaatttattatttaagcaaaatattatgagtgcttataagtacaaaggctaaaactgatatccctaccaaccacaaaaaaataggccaggcagctgggtactgcctagcctatttttttgtggttggcagagatatctctttattgtgtagatatttaaggactcatatagacccatcattttttatgggcaaaaatcccaactctggtcttctaaatgtcttttgtaaatttatttccctaaataaatcataaatccacttataatacctagacccacacaatgtgtattcgtcatagctgctcaaaaggaatccacagtgtaggtcagagctacttgatgagagaaagtcttgactctgctaataatgtttttacctcactggcacccacagtattttgccagattgcctgaagtcagcatgccttcctgatggtcatggactgttctgcttttccaggaatgtctcaaagggatcctgcctgaaaggaaagaggccatactgtgatatttcactgcttataaagagaccaagaatggcctctgtcttgttcttttagctagcttcaaacaaacttagccagcttaaaaacagaaatggaactgatgaagtcatcaacctagagcctcccgctactgcccatgtattttgtagtctagaatgaagctaataatctcaagaactgcttcctagaaaggttaaggagaaaagcatgccccatcccacttctcctcccatttcccactcttgaaatagcattgttagcatctgatgtgagccagaggagtatttgaggctgtgccatatgtccttgttagaaacactgagcttataatgactaagaaactccagggggttgtctaaaccaccaaggttataaagggcacagcatcatcacagctgaactaaaatttaatatgattcttactttaccacccatggtgacctaagaaggtggtaagggggacaaactctaaatagagggctcagttgtggctcaccaagaagctaaatatgctgttttcatggtagaatagggaagaagaaactggtaaatatttccaaatgtcatgtgtttacatatgaatctattcacttctttatttttaaaattcttctgagaagtactttagaagtaatccctaaatttaaagtatttataacaaaaattttacatattctcaccagtttagagcattacccagaaggaattgtgactccatggtccaggggattagagttagtcattaggggtgggaatttcttctcagaacgaagttagagctctgtaaccatcttatgtgaccaagtagatgtttgagaaagatctggaattaacgtaatgaaggtgagtagcactgagaatgcccatagagtctgtagcttagatgggggtgggtgtcaccatgatcttagtgttgcactttttggaaactaggtttaggtgaggaatgaagtcacaatcccctaagaagggaataatgaataaactagttatatcagcttattactttagagtagaaaacagacctcatgcaggaatcattctgcatatgtggtgaagccttcttggtgagcagacaaacaaaaaagaaaattcactttttctaaaaaaatagcacatcagacctttgtagcctggagaactcattcttctctactttagaggtgtttctttttctaataactgggaagggctgtctctaaccggagctcctgtaccacccctaaagatatcaataatttctcattctccaacttttagttttcccatttttattggtcctcaaaactttgtctttgcggcactccctgcctcatcatacttgtgacaagttgaattcctaagactcaggctcgtattacaaaggatgcaatttagatgagcaactccctggtgagatgagtggctctctggcaaacggggtggggaacatagagaactaagagtcaggaaacttggggcctatatctagggcatctgttacctaacattctgacccagactatgttttccttgcttcagtggcttaggctgcaaaataaggtccctttcacctttgacacataatccagatcttgtactttactttagtaattttagaaagaagacatttaggccgaggagatgaatgtctgttctcattgaggtaatgaggttttctaccactttatttttcttggtaaagtctttgcttataatctggcagcctttatttgtattcctttttcttcctttggctggctggagagcaagtgccattgacatggcccaaagagtatcatcttttcagccttggagcaaggagtctcagagtagagcacccccactccctccccaaatgcctgtgaatgacaaggcaggaaaaacattttttaattaagtcaattcagttgttacaagttgaattaatctctaatttagggatatcatgggaaactatttataatatatgccagctgacccttatccaaatttccatggaaatagcaatgttataacacagggtgttcttggactgctctaaaaattccagctggtttaagtatgatattgaaccgaaaaatgaagccttctactaacaaatgtgttgaagtatgcactcaggtgctcaggaggtataggcttagcttgaaaaaattcaaggcatgataccctgggctttccctcaaacctctttaattaagacctctgatattgttgtgttgtttctatctgaagtcaaatgggaattgcagaaagttttgcagttttttttttctcctccatgaggtagagattcgtctatgccaggagaagtgaagatagtcacgtctttctcttgaatgatgtaataaagttttgcaagggataaaccatgtttcacttgtatcagatttatttatcaaatgtgttgccattaagagtatgaaaatatttcagctgaggccaggcgcagtggctcacgcctgtaatcccagcactttgggaggccaaggcaggtggatcacctgaggtcaggagttcaggaccagcctggccaacgtggtgaaaccctgcctctactaaaaatacaaaaattagctgggcgtggtggcaggcacctataatcccatctactccagaggctaaggcagggagaattacttgaacccaggaggcagaggttgcagtgagccaagatcacgccattgcactccagcctaggtgacacagcaagacactgtatcaaaaaagaaaaaaattcagctgaaataatagcatatgggagaaattagccatgtatttataatacgcgtagtaaaagtgcagacgctatgactatattgcatgcttggtgaaagtaatggcaggtttgctatgttcaaaacatttgaattaatctgttcaaaccatgcacagcattacagaattgacattccagcacagtgactgcagtctgcagcagttgcagttttgtcatctatacaacgtcaaacaagatgcaaaccaccaggcttggtagatagaataccctttgagaattaagtaatcctgagatgactttgctcatcattgatgtcctgtgacgtcaactgaaggcttgtcttgcccatttcaccttgtcattgtggttattggttttctccattaaaatggaaaattggattatatttagcagaatgaacatatatttgatgctttaggtaaaatatatacagtcatatgccacataatgacttgatgttttaggtaaaatatatacagtcatatgccacataattcaacattttgatcaacgatgaactgcatatataacagtggtcccacaagattaaaattaatatttttactataccttttttatgtttagatacacaaatgtcattgtgttacagttgcctacactattcagtaacatggcatactatacactccattgcactccatgtgcgccattgcactccagtctaggcgacagcctaggtttgtagcctaggagcaaataggttataccacatatcctaggtgggtagtaagctataccatctagattcatgtaagcacagtctatgatgttcacacaacagtgtaatcacctaacgatgcatttctcagaatgtatcccagtcattaaatgatgcatgaccgtatgtattatctgaagttagcaccctttagcaaactcctgaatcattaatttgcaaccctttggttacatcttttttcttaccattataagaatttgcttaatatgaatttgtggattaaagtgatttaaagtgctctctatatcagggagattagccctttgtctgtgatatgagatgacaatattttttcccaagtttgacatttttcgtttgaaaaattttttttgtcatgtagattgaaaatttttttccagtacaataacgcgtttaacactggggatacattctgagaaatgcatcattaggcaatttctttgttgtgcaaatattgtagggtagacttacacaaacctagatggtagagcctactacacacctaggatgtgtggtatagcctattgctcctattttacagacctatatggcacgttattgtacttaatactgtaagcaatggcaacacaatggtaagtatttgtgtacctaaacatagaaaaggcacagtgaaaatatggtattataatcctatgggaccattgtcatacatagtccatcttatttatttatttatttgttcattcattcatttattttttgagatggagtctcgctctgtcgcccaggctggagtgtagtggcgcaatctcagctcattgcggcctctgcctcccaggttcaagtgattctcctgcctcagcctcctgagtaatccccacaatctcagctcactgcaacctctgcctccctggttcaagcgattctcctgccttagcttcccaagtacctgggattacagatgcatgccaccacggctggttaatttttgtatcttttttttagtagagatggggttttaccatgttggccaggcttgtctcgaactcctggcctcaagtgatctgcctgccttggccttccaaagtgctggaattactggcaggcccatagtccatcactgatggaaacactgttatgctgtgtgtgtgactatagttgttgctgttttttttttttaatccacagctgacctgaaagtcttttatgtctccagattttaacagaaagccttccccactctgagttagtagagatagtttcctttgttttcttctagtattttaattatttcatttttaaaatttaaatctttactcctttagaatttacctggtatatagtatgaggcatgaattcaacttaattttattaaaaacacctctccagttttctcaagacaattggagttgttcgtcttttcctcactgatttaacttatgtatttatgtatttatttatttatttagagatggggcctcactctgtcacccaggctggagtgcagtggtgcaatctcagttcactgcaacctccgcctcctgggttcaagcaattcttgcgccttagcctccccagtagctgggcttacaggtgtgcaccaccacacccggctaatttttatatttttagtagagatggagtttcaccatgttggccaggcttgtctcgaactcctgacctcaagtgatctgcctgcctcagcctcccaaagtgctgggattacagcactcccaaagtgctgggattacagtggcatgagccactgtgcctggcttagataccctgtgtatcatacaccaaattctgtatgcattgagatctatttctgaatttcctgttctgttttcttgatttgtctattcctgtgtcaggaatacaccttcaactattgtagctttatattattttataataaatgctaggaattgtccccctcattttattctcttttagagatttctttgaaatccttgttttatttttttctgtataattttcatttttgaattgacacataataattgtacatattaatggagtacatagtgatgtttcaatatatacaatgcttagtgatcagatcaggataatcagcatatccataatctcaaacatttataatttctttgtattggaaaaattcaataccctctcttctagctatttgaaaatatgtaatattgttaactatagtcaccctatagtgctataaaacagaacttattcttcctgtacagctgtaattttgtgtcctttaacgtatctcaccatcttccccttcccccatctccctatcctctagtaacttcttttctactttttacttctaagagattggctttttttttagctcgtgcatatgaatgagaatatgaggtgtttaactttctgttcctggctattttcacttaacataatgttcttcagtcccatccatgttgcaggaatcacaggatttcattcttttttatggctgaattgtgttccattgggtatatataccacatttccttgattcatttatctattgttggacatttaagttgattccttatcttagctactttgaatggtgcagcaataaacatgggggtgcagatacctcttcaatgtactgatttcctttcctttggataaatgctgagtagtgggattgttggttcatatggcagttccatttgcagttttttgaggaatattgttctccatagtggttttgttggtttacattcccaccaacagtgtgtaagtgtttccttttctctgcatcgttgttttttgtctttttgataatagctatcctaactggggtaagatgatatctcactgtggttttgattggcatttccttcatgactagtgatgttgagcttttttttccatgtatttttttggataaatgtatgtctcttttgagaaatgtctattcagatcatttgcccattttttaatcagatttttttttttttgctgttgcgatgtttgatttccttgtatattctggatattaatcccctagtggatgaatagtttgcacatattttctccattctacaggttgccttttcactctgttgtttcttttgatgtgcggaagcttttcagttggatataatctgttcatttttgcttttgttgcctgtgcttttgaggtcttattcataaaatcttgccccagaccaatgtcctggaacttttctcctatgtttttctctaggagttttatagttttaggtattacatttaggtctttaatccacttgaagttgatttttatgtagagtgagagatggaggtctagtttcattcttctgcatgtggctatttagttttcccagcaccatttattgaaaagattgttctttcccccaattaacgttcttggcatctttgtcaaaaatgggttgcctgtagataaatggattaatttctgggttctctattctgttctactgatctgtgtgttattttttaatgtatactttagaatttgtttgtctcattctcccccgacccctacccttctccaatttttggccttgttactgtagttataattaattgctaaattagcttagggagaacaactttatgaggttgagtcttcctatctaactaacttggtatgtcttcccctttgtacaagtctttgtgtcttcaggaatgccttaaaattttattagtaaatatggcacatttctaaagctttttcttaagtatttcatctttttctgttgctattgtagatagtcttcccccatttcatcttccaactttctgtgtttgtaatctaaaatctattgatataataattctctatcgtgctgcctaagttttcttgtttactttttcaattgaatgtcatagggttttctatattcatcagaaattgtagtagttttattatgttctctaaatttttatacctctagtttctttctcttagtaattgtattgtctaatatctaatatctaggatgttaagtaatggtggtgacaaatgagcatccttctttgttcctgaattgagtgggaatacctctagtgttgtcctgctaggcataatagttactttgggatcaaggtatattttatcaagttaagaaggtatccacttatttctaccattgatttcaacatatttctaaatcatagtaaagccccagggctatgtacctgcaccatgataggataaaagctctaaaaggaaagacacttaagaccctctagtctaccttcctcccatcatgagtattaaattccaagcacaggaaggttgtaactattccctgccccaaagtcctaaaattagattagaagacaatttggaacactgtctcttaggtcttatagcagcgttttttggggtatgttaggctaacactatttctctataacattatttctcttcctttgtgctctctccttgagatttttccattttatccttctcttctcatctcacttctgggacttcacgtgtattgcttggctgtgcattcttcctccagcctgccattgctgacaagccaagtttatcttaggagagttctagacagtgacataatcccttccccacccaaaaagactctttgctatttgctcttcctggacaaagtacattgtcttccaaatgctgttggttacatctggaattaaagcagaaagctcattggagctgctgaacacctcaaaatatacttcagtttttacagtgcctttagcaaggtgattttagccaacagtgaaagtatcataggcactactgtatcttatattcatttgtaggtggtattcagatttcaaaagaaattgtcataatatttattatatttaaatggaaaacataaacaattacatattagtgctatacttctgattttagattcacctgtgtcataactttaacatcaaaattagtaaatgtttcatatgctaagaaaacttatatgcaaatggaaaaaatctaagccaattattattttcataatgttctactgtgaaacaaaagatagtatttctgtccatatgtagttatcagactctggagtcagatagacttgggttagaattctggatttaccaccacctggctgggtgactggacagaagtaacatattctcaactgagtctcacattcctcagctgcagaatggggacagaaatactttgtacagttatatgagaattaagaaaatgcacacaaagtgcttagccagtggctaccatgccctaagactttaacagatgataactattaccatagcctattgttaatggctgtaataaagcctgttgtttttaacttttattaacttaaagaataaatgttgcagtttgactcagtgtgggactataattgcaaagcaactcatttatccacacagcctcctttctgagaattagaactaatgtacttagaaggatttgactgaagttctgctctggattttcttaggaattatttgggcaaccatgtccattaacacttatctagaaccgcaaggctgaaagtatgttattgtttgattaggttttcattagccaattattatttattgaccatatgataggtggaatagataagtatcacaaaagacatacgattcctactctacacatttagaactaaaaacagaagggcatctttgatttacttaaagggtccactttgtgctagatataataccatgccctagggatacatagatgaaaagatagccccctactctgaagaaacttatggtctagtatggtgtctagaatggaacttagaagccacttcttataggaagccttccctaaacttcaggtagggaaaatttccctcttatgtcatagcccccaagcttacacttaagtttggcatttgtcacactgtagattgtctgtctcctatgctagactgtaggctgcttgagaacagggactatgtcttactcatcaccgaagaaaagaagatgactaaaacatcatcttggcccttgaagaacttaaaattgagtgacaaatataaactacgaacatctgtaaacaactaagctcaaaatacatttttatgaattataaattctacagagtatatgctacaagaggtaggaggttttggaaagatgatttagaagatacggcatttcagtttagaaggaatggtgtgatttccatggttgaggtgggcaaatgaatccaaggttaaggaacatcatgagcaaaggcacagaatcgggactgtacatgggctacttaaggaatagtaaggagttccatgtgagtggactctggtaagaatgttaggtaggggattggttgtagctgatcttggatgcagtagtagggtgtttggattttcttctgcaggcagtggtgcattgacaaggatatttgagcaaaagggacatgattactttgtcaatagtgtaaatgatgggaaaagagagataatattcaggaaggggactcctgggactgccaataatgtagacaagaggtattaaggtgagaatagatatggaaagggaacaattctggaagcattgtgcaaattgacttgtcagactctaatttggaataagggcgattccaatttaaaagtccttatttcctacctcggtggagcttgcagtgagccaagatcgcgccactgcacaccagcctgggtgacagagtgagactccgtctcaaaaaaaaaaaaaaaagagtccttatttcaaaggtgatggctctagtttacattctccgtcatttacatgctctggccatggcatgggtaaagtcactcagaaagcgtttaaagaaaagccagagggaggtcacagaaccttgtggaaaacttatatttaaggggtaggtaaatcttcatatttagaagagattatgtttcaaaacttactaaaaagacaaaaatgggctgggcacagtggctcatgcctaaaatcccagcactctgaggccatggcaggaggattgcttgagcccaggagtgcaagatgagcttgggcaacacagtgagaccttatcactaccagaaaaaataaataaattagctgggcatggtggcatgtgcctgtagtcccagctactaggctggctgaggcagatcacttgagcccaggaacagtgaggctgcagtgagctgtgattgtaccactgcactccagccttggcaacagagcaagaccctgtctcaaaaaaaaaaaaaaaaaaaaaaaaaagaaaactcacatagttttcatcctttaagtggtttgcttaagttaacatctggtttatggcagagcccccaacccctgacatgtagctcagtgcactttctattttatgctctagattttagtttaatgctaaatgtgaggatatcacctaccttttccatcctcatctatcttagtaaaccggattaaatttgaattctggacccctctactttaagtatcttctatctcagccaggcgtggtggctcacgctataatcccagcactttgggaggccaaggctggcagatcacgaggtcaggagttcgagaccagcgtggccagcatggtgaaaccctgtttctactaaaaatactttagctcggcgtggtggcgcacgcctgtaatcccagctactcaggaggctgaggcaggagaatcacttgaacctggggaggtagaggttgcagtgagccgagattgtgccattgcactccagcagaactccgtctcagggcaggtgggtggggtggggggggcgttgaaagtatcttctatctcatatgttgatagctaccaatagcaaagagaaaattgtgccactggaaaacagggcaagtcatctatatggatgccacttaaaattatgtgatatgaattgatataaaaagcctaattaaatctaccttatgtttcaaaggcggtaagttaatcttttacattattgtttttatactctactctttatgtaaaagaaaaactacttcattttcaaatggtaaattattatcacccaaatacattgctgtatacagaagtggaaagattttgctcaaataagccaaagctaatgatttcattataattctatagaagtttttgttggtactaatactgtaattgtctatagcatatgccataggtattgtttgaaattgtttttatctcttaattatcaaatgaaatatacctcaaagagggaggcctgaaaagacatgaaactttgaaatatagagcatcttaaaaagcaagtacatggtgacgccagtcttcagaatagcatcatccctgttgaacagcataaaaaatatatggatttgatgatctatttggctggaagataaaaaatgaaccatcatgagccattattaaagaggtgtttataactgaaaaactgtgataaaggtcagttgacaaaatgagtggagcactgtaaatactaagagttgatggcccatgcctagataattcagtgtttctattcttagaaaatggattttaaccatttgaatgggcctagtaaatgatcctattacaattttcacatatcaattcatggtttacccaaaaagatgtgcagcatacttttaaattggcctttttctggcagagagtttccagaaaaataatgtgtttttttttgttttgaatttatttgcttactttgggtttttcttaagcaagaatattaaagtacaatatacatacagagaagtatgttttctaaatgtacaactcagtgaagtttcacaagttgaatatacttacttatccagcacccagatcaagacacaaaacatcaccagcgcttcagaatctaccatctcttacttccttccaatcaataggtacttaccaccctaaaagtttattgggagacaattctcccatgtgtctcatgtttctgcatatcttgtgagcaaaggcactgactgcgtgtgttcagaatgtctttccaaggcagccttggaagaccatgtctccagagcaaagggcaggtgtgcttatagtcttgaaaatagagattatgtcccttagagagcaaagaacaggtttacttactattcggtataatagagatgtctcccttcaaagcgaaaaggacaggcatgcttactgcccattataaaagattcagattccctatgttccctacaggagttcctctcctgtaacacaatccactgtatgtacaggtgtcacttgactttctgttgccttgtgggaattagagctcagggaaccagtgcaaacactgacactctgactattgagttgtaaggtcctttgtctctgacctagcatgtaaggctaacttgttaagcttgcaaggagcgtaaatctcagacccgtcactgtccttggtagtaagcactattctgacttctaccaccatagattagttttacctgctgttacacttcatacataaaagaattatatagcatgtactctgtctggcttcttacatccaacaacatatttgtgagattcattcatattattgcatgtaggcataattctttcttaatagtataccattgtgtgaacattttaaaaaattgggtttttttttccactattgatggacattagggcagctcccagtgtcagctattaaaattctgttgttagaaatactttatgcatgtctttgagtgaatatatgtatatatttccgttgggtatattcctagaactagatcagagggttcgcactggtgctgccaaacaactttctaaagtatctgtacaaagctgctctcccataaacagtatatgggccttttggtatctctgttattttcaacctttgttattttccatcatctttgttttgttttttttcagtgacatgcttcaattttaccatcatccattcataaggaaagatcccattggcataatggaattataccattggcataaaataaatatgccaatggtcgggcggatcacaaggtcaggagatttgagtccatccttgttaacacggtgaaaccccgtctctcctaaaaatacaaaaaattagccgggcgtggttgcgggcacctgtagtcccagctactcgggaggctgaggcaggagaacggtatgaacctgggaggcggagcttgcagtgagctgagatcgtgccactgcactccagcctgggcgactgagcgagactccgtctcaaaaaaaaaaaaaatatgccaatggtataattccaatttcacaaaacaatctcacaagcacttccactctttaggctgaggcaggtgaatcatgaggtcaggagttcaagaccagcctggccaacatggtgaaaccccatctctactaaaaatacaaaaattagccaggcgtggtggcacacacctataatcccagctactgaggaggctgagaaaagagacatgtcaattactaagttgttaccaggacaagttatcaaaaaggacaatgaaagccataaatattttgtagtttatttacccatgaacacaatagtttccagtcttccgcatcagataagaccaagttattcaaattaaaatgttaaagatacggttttaacagaaacaagaacaggctgaaaactgccatgaatatccatatccacataatgtacaaaaaagaaagactgatattattccaaatatttctatttgaaagtaaaagaaaatctgtacagctgaatcttcccagtaaacagaaagagaaaatattataacacagtattaatcttccacataagtaaggccatatgcaaacaagaaagagaacacccaaaattgcagtgtttcttcaaagaacccttctctagggaacatatttaacactccaaccatcttctattcttctacgtgcatactaaaaaaaagtacttctcttcccatcataactagtcaacccagtgtaaattctaggcccgattttcccctgaatcatttctgcctttttgttcagttttccctgcctagagcacccatcacaatctctttagttcttctatccactctgaactagaaatcacctttcattccatacagctctgtagtcctttaaaccctctaggaattgctaaagaggggtgaggggctgagaagaaaggagaatgggcaataagaggtctggcagtctattttacagaacagcctgcctctggacatgacaaagagagccaagaaactaaaaagcctgcttctgcggatgtttctgaactactacttttgttttttttaaaggaagacagaagagatttatgagagatgagagaaaagaaagtgtacactcactctggcacttcattaggttcaggaagggaggcaaataaaggtacctagattttgaatgaatccactggttgtggctgagaaagcctggtacttgtcaagaacaccaacatattaaccttgccatgaggatagggtctgacatgtcccctcaaccacctgtctaacaaacagtagggtttctgagtgatgagggtggtggtggtaaagagaggtcttttggaagaggaacaggtcttttgtgtgctgacaggaaagctgtgtccaccaccagtgttctggagatccctgtttattagaaaccagagagtggagctggcaatggtctgggatatgttcactcagcagggagctgcccaagtagcagtacttgggaatagccagtagcaggcagcaataggtgaccagtctcaggaaaagtaatggggtcccataattcacacagaccaacttgccccctgctgttctcccttgacttcattaatgcccagcaattgtccacaggccatgcacctgtactgtcagatgcagagcagggtgagctgaataggttcttagacacagctagaaatccaagtaggaggagccagaccagaggtcctgggaacaaaccgagtccaaacaaaggtaaatacagtgtaacctacagcatcattcgcttcgcttagaaggatgtgacccatcggctgggagcatgtgatgttaatgcagaatagcaagacgaccaggtgaaaggggagcagcacagccaccaaggtctcaatcttcaggttgagagaacggaaagtttaaacagagggtacaggaaagtcagaacaaaaaaagtaaagggcatacctaatgctgttgcccaagctcaggtccagctggtggtggcaggcaaccttctgcaggagtaattccaaaggcaaaggttaaccacactggaacccaaagggcctggggatctccactggctcccttaccaggcgacgtctagctctatgggcgtcttcacccaacaggtagtactgcagtggatttgaccagaggtcctctttaataatctgagcaatcctgtcggactctggaaggctgtggtctgaaaaccaggtgaagaagctgcagatgacatgtcggttcctatgaatgaaggactggggtccatggccccggcgccacatgattagagtggaaaaagacaccacttggccgaaggatctgacctcatacacctttacaatcagcttgtttctgaagtaagggtttctttgaaagaagaacttaaacttgcagcctgtcctagggtgtctgagctccttcacttccaaattggttaagtagcttaacatctcggcatcttggcctctaatcatggcagacagctgtgggtggtggcggaaagcagtgacccagaagcccgggatattgcgaatgatgtcattcctctgctccaggtagtattcatgaatctgcccaaacctgcgctccacctgcaggagcgccctgtcagcctctgcattcacggagtccagttccagctggatggactccagggggttcaggtggagacccacgttcaggggcccgggcccgggcccaggccctgcctccctgtttacctcatctattgctctgttttcttccgccacgtccatttcttcgcctcctggcttctcatccactggggctgagaacatggcacactcctcaggcttcacgtcctcggccttcccctctgcaatcacttcagactccgacctccctgccccacaggtttctagagccttctccccacctaggccgtgcgtctcttcacccggaaagccatttttgaggctgccgtcagttgtcagcgaggcagaggccgcttctaggccctccgcgggtggtggagtcacttcctgccccgctttgatggctccatgactgcgacccgcatcgaccaagatgtggaaagtatggccaccatctgcgggatcctggggcgcgaccccctcctctggaagccggggcggtgggaacacgattggctccaagcggccatcaaacatatctgccattacctctgtcgccttgctcttttctcgggacctctggccctggtgcgggtcttccagagcatagtcgagagtagcggggctgtgaggactctccgggaggctcatgttggtagcggccagggcagcagtgggtagaggccaggccagaggtaggtagcgtcaacgttcctcacacaaaatggcgagtaaacacctcgcccatttgcgccgcccactcttcagtctcgcgacacccacccctcagtctcgcgacactcactcctcagtctcgcgagtctgtggtggtgtctttacgtctttgttattttagccatcgtgctggatgagtaatgatattacatggtggttttaatttgcatttagccaaagtctaatgagctgagaaccttctcatgtgtttgttggccactaggatattctctcttgtgcagtatccgaggcttctccctatttctctactgggctgacgttatttttcatatggatttgtaggaagcctttgtacatgctagatactagtcagtcattcttccagtataggtattacaaatatttctcttccagtataggtattacaaatatttcctcccactctgtggggttacttttcttttggactcgtagtttcgctgtcgccgaggctggagtacaatggcatgatctcagctcactgaagctgccgcctcccaagttcaagcgattctcctgcttcagcctcccaagtagccgggattacaggcgcccaccaccatgcccggtttttttgtttgtttgttttgttttgttttgttttgtatttttagtcaagacatggttttgccatgttggccaggctggtctgaactcctggcctcaggtgatccgcccatcttggcctcccaaagtgctgggattacaggcatgagcaaccgtacctggcctactttttcaccatcttaatggtaccttttgaagaacaaaagtttttcatcttaatatgtgccaatttgtcattttcccctttaccttagtgtttttctgctctgtttaagaaatcttacctctcacctgggcacagtgcctcacacctgtaatcctagcactttgagaggcggagacgggaggatcagttgagcctaggagttggagaccagcctgggcaacacagcaagaccccatctctatttttaaaaagaagaaaaaaagaggaatcttatctcaccaagattgttcaaatttatatatgccatccatctggaattgatttttatgagtggggtcacaatttctttttttccatatgaatatctaattgacccagcactgtttattgaaaagacaattctttccccatgcataggtttttaaatgtttctgtcagaagtgacataaatcattggctacagctagtcagttggccttgtctaactttaataggacagggaggtgtaatcttctcttgagcctggaaggaggaaactggaaatattggcaagtgctgtatcactcatcatgaaaaataatttgagaaatatataaaagaccaatagaattaggccaaaggacatagagaaaaggtaataataaacaggagaaatttatgtaagacaatacagagcattaaccaaagattaataataaaaggagagagaaaataagcaatatttggagagaaaattatagtcacattgatggtttaaataaatataagacaggatgttagacagctttatgccaatacattttcaaacttagatgaaatatatggcttcatagaaatgtataacttatcaacacggactgaaatgcaatagaaaatctaaatagacctagagacaataaacaaatggaatcagtagcttaaaaaaatgtttccacaaaaatagcatgaggttcaaatgattttgaggcgactgctaccaaaccttcaaggaacacataatccatttttatatttattaaacattcaacaaatatttattaaacattcaacaaatgtttattgggtacctactgtgtgcctggtactcttataggccctctggatataacggtgaacagaccaaagatttcttccctcttggggtttacattttagcaggggagaaagataataacaagaaaccaatattgcacattagaaagttataagtgctatggaaaaaacaatagagcaaggagattgaaagtcctgggggtagggagtggggaggagattgtagtatgaaatagggtggtcagaggaagcctcattgaaaatatgagattttggcaaagagtcaaagaagttgagggagtcagctagtagaaatcctggaggagagcatttcagcacgagaagtgctaagcagaggcactaagacaggagcatgtctggaatgttcaagaaataacaaggaggccagcgtgactggagcacagtgaatgagggaggctagatcaagtagggtcttgtatgatagtgtaagaaatttggcttttattcttagtgaaatgggaaattactacaggattttgagcagaggacacaaaatctgacttaagttttgcgtgaatcactctggctcctgggtgaaaaataatctgtatggtggcaatggtagatttagggggatcttttgggaggctactgcagtaacccaggtgaaagatgtttctcagaccaggtggcagcaatggaggtggatggtggacatagtatgatggtagagtcagcctgatttaatggtaaattggctatgggatctcttagttcattttctgttgctgtaactgaatacctgagactgggtaatttataaagaaaagcttatttaactcacaattctggatgctgagaagtccaatatgctgtgctatgaagtagcatgacaaaaaagcagaagagcaagcaagcacctgggaaagaatggacaagagaggctgacttgcattatagcaacccactctctcaaaaactaatccattcccatgagaagttatccagccttgcaagaaaaacataaatccatcttaacaacctgatcacctcttaaaggccccacctcccagcatggggtgtaagagaaagagagaagtcaaggatgactccaatgattttgacatgagcaactggtaggatggagttactggaagcagagatggtgaaggttataatgaggaagatctttgcaggaaaatcagagttgtctctcttttttaacatattgtttgagatgattattggacaccagagttgagatgccaagtgggcataatgagtttagagctcaggagaggtctgagatagttattcacattttgggataatcagcatgcatggaatttaaagtcaaagggttggatgagaacactaagatagtgagtcctgataagctgggccctgaagactccaaaagtataaggtcaagaaaaagaggaaaaacagcaaggaagactgaagagagaccagcagggtaggaaggaaaccaagagagtgcaatgtgcttgaagccaaatgtgtaaaggaaggtgttcagctgtgtcacagggtgctcacatgtcagttagtatgaggtctgagaattgaccgtcggattttacaacaaagagtcactggtgactcaaaaagagcactttcagtggagtggtgggggttgaaatatgtttgaaagggaaagggagaaaagaaatggagattgaatattgacaattcttttgaggaatttttctccaaaaagaaacaaagaaatgggatcatgacaagagtagtcaagctactttcagtggagtggtgggataatagcttggctggaataagtttaagagaaaacaggaagcgaaaaagtgaaaacagcgagtatatacaactgttttgagaagttttgtttcaaagaaatgggatgatagctggtggggaaatggatcaaagaacgtgtttttaaaatgggagatgaagcatgtgtaaagaagcaggttgatgtgaatgatccagtagggagcataaaactaatgatgtaagagacagaaggaagcattattggagggatgtcctggaatagacaagaggaggtggaatctagtacctaagtggagaaggagatgtcagctttaggagcatggcaagttcactagtggtaactggcaggaagtcaaagtgtgaggtgtatatgctagtaaacaggtagaagtgatagtgagatttatgaaatcgtcttctgattgcttcattgttctcagtgaaatagaaagcaagatgatcaaatgagtgtgaggatggggcaacaggcagtgggagtctgaggacagagaagaaggtatgaaatagttgtctagagagaagagtgactagactgtgacctaaagtattgtcagacaatgttaaagtcatgaattggaaatgaggcccatcagcatggctatgaatttttctccagccgcattcaacttacagctgcagtgtgaataagcagagttggatttagacctgaaacaagaagggcaagagaataattataataattgatcttagagtttaagctggaggacggaagacatacaggatgaggtcagtgaaaaggtggtctgatcaatgaattggaagattcagggtactgaaggtctcctggggtcgagtcctagggagaataagctagagggctgagagacagtggtttgagaatgacctgcaagggattagtcagaatcccattcatgaatccaaggtggtctctaatgaggtagacagaggatagggtaaggtcattgcaggggaggaggtcaatgagccaacaggccaggatgggaaggatagtctatgtgtatattgaaatcactgagagataagacaagagagaagtgagaatgaggcaggagctaaaaaacatgagaaatgagagggaatgacatgacagtagcaacgttttagggcaataggtggtccaaaccattgacaggagactcaaagctggatatgtattctagggccaaggtatatcaccactacctttcgataaaatcagttagtgggaaggcagacacctttagaattttatatttcttaatgtcacagaccctggtattatacatctccccaagggtacacatacattaggaaacatgtattttttaaaattgaaaggtgagtagtgatattattctttgagttcattgtgaagtgttattttcttttggggttccattctgctttgttttaaggcatggactagaaacagttgaaaagaataatatacaatttcaactttggagcctgaaatattctggctataatttttttttcctaaaaaaagggagaacaaggagagctatataaaatctctgaaatgttttgtcaactagaggcagaaataaagatgtggagaaagagggagagggagaaaaaggaaagaaaaatgaaaaatgagtaagggaaggaagaacgatatggcttcttgggaagagtacaatttagccactaatctgcacatcacagaattgtaaagtgtttaaattctctgggaaacagaaaaacatgatgttttaaaagataaactcaatattagatgactgaaaagagcctgtgaattgtatagtcttgttttccttggactcctcaaatattctttttcagttcttgttttgaaagggatccctctctcttgacttaaattctttaaacaacattgtttatatagtgatttaacatacagaactatttttcttagaactaggccacccagtttagaaagctgagggcctgaatacaatatgttactttcgtaagattcaaaagaatgttggtaaacaagagagggagatgtacactttgctaatttcttctgtttcccatggaaagtttatcaaactgtttgtgaaggaaatggtcaaaaagaagttttaagtgattaaccaagtagctttacagctgcagtcgtctttattgtatataaatatagataagagaggagaaaaatatttgagttaccagggcatgggaaatgatttaccttggcaaagttaataaattatgatttaatcattttctactaatgtagcactcatagaaagaaaatatacattattgtgcctggtgaaactgtaaaaggctaaaaggtctatgtagagtcctggcctgatagactagccccagagtgtttcagccaggggtgagcagagccacaggcttgtgactggacctgtgtcctggctagtgtcaagcatccccaccagtgaatgcgatacaggagcaaaatgatgcaactgctgttacagtgtttatgttacacaaaaccaaaataccagtatttataccagactcttattttaaaagtgttcagaattcaggaaatacaacagtgaaactaagtaatacgttttaaatgcaaattttaaaatagatattataaaatgtttctaatatctaagtgttagacataatcactctagcctaatttagataaaaatttttaagtattagaaaagaaattgatactacagtaaatgaataagttggttaatcatggaaaattgaaaatgaaaaagagtgcattgatgatgtcatcattaccataagagtattttttggagcaaattttttccagctgctataaaagcttccagtttctacactggtggcagagaggtgaacagagttttgctctaattcctattattttcttgagttgtcattttaggataatctctctgtgattactttttttttttagaaataactttttatggatggcaaactgtagtttttgtttcaagtaaagcatttctggttttaactgtatcatctttaatttatcctgtttgaatatagattaggtacaactgtatcaacctaattaattactgtcccattcacattccactttattgaacggtctttgaagtaggagtaagatttatgtatgtgatagaaggtttagaagctgggtgtagtggctcatgcctgtgatgccagcactatggggggccaaagtgggagaatcacctgaggctggagtttgtgtccagcgtggacaaggtagtgagaccctgtgtgttaggtcattcttgaattgctataaaaaaatacttgagattgggtaatttataaagaaaaaagtgtaattggttcagcaggctttacaggaagcatagtgtggcatctgctcatcttctggggagacttaaggaagcttacaatcatggcggaaggcaaaggggcaacaggcacatggcaagaggaggagagagagggaggtgccacacacttaagtgaccagatcttgtgagaactcactcactgtcaagaggacaacatcaaggggatagtgctaaaccattcatgagaagctgcccccatgatccagtcatctcccaccaggctccacctcgaacactggggattacatttcaacatgagatttgagcagggacaaatatccaaccatatcaccgtgtctctacaaagaaatttaaaaatcagccaggcatggtgctgcatacctgtagtcctagctactcaggaggctgagatgggaggatcgcttgagcccaggagttggagcttccagtgagttatgattgccactggcactccagcttgggtgacatagtgacacaccctgtcgaaaaaaaagctttgggttgtccattgatattttctctttcctttggaggagtatagagttgctccttcattcttttcaaattttaatatagtgtataactctttgcatatgtttcaagatgataattcagcaccttttacagtactggataatcatagtaaaataaatataccagaatttcattattttaacatacaccatatactgaactgccagaatactgagagaagatattacaatcactagttgaaaccaggaagccagcttcagtcatcaaatccaaacaaacagtgagcacaggaagagcagtaagtgcctatttattgaccaccttttgtgtgtcagggaggtgatagatgtttagtggtgaatgaaacaggcatggatctgtgtccagaattggttccatctggtgggttcttggtctcactgacttcaagaatgaaacgacggaccctcgcgatgagtgttcttaaagatggtgtgtgcagagtttgttccttcagatgttcagaagggtccggagtttcttccttccggtgggttcgtggtctcgcttgatttcaggagtgaagccgcagaccttctcagtgagtgctacaggtcataaaggtagtgcggacccaaagagtgagcagcagcaagatgtgttgtgaagagtgaaagaacaaagcttccacagcgtggaaggcgacccaagcaggttgccgctgctggctctggcggtcagcttttattcctttatttggccccgcccacatcctgctgattggtgtgtttacaatcctctagctaggcagaaaagttttccaactccccacccgacccagaagcccagctggcttcacctctcagatcctgctcagggagcttagaatgaagaaggcagaagcaggagactagccaggaagggcggaagccaggcagacagtgctgcaaactcacatgtaaaaaacaaggtgggaggaaagggagaaggtccaaggtaattgcccaaaaagggatgccggtctggagatgggtggatgcatattatacagaaacaagtagaaatcttaatgccctttcaaaaatataagtataaatttaggtggtgagttgtttcaacaagatacatgatccttgtttggggtaggggacagtaaagctctcaaaagcattcttgggacagtggaggaaattaaaatagggactggatagtaaatgtttaaaagaattacatgaattttcttaggtgtgataaatggcattaaagtatagaaaacagcattcttattctcaggaaaggaattttagtatttagaagtcaagtgttaaggtatttccaacttaccttcacaaagttcaactacaatgccaaaaacaaacttatggggagagagggaggaaagaaaatatagcaaactttaactaggtggaattatgtagctatttgattgtactatgctttctatgtatgtaggaaaatttgtataataaaaagtagggggtcaaaagataagcatgtgtattagtccattttctcactgctgataaagacatagctgagactgggaaatttacaaaagaaagaggtttaatggacttacagttccacgtggctggggaggcctcacaatcttggtggaaggcaaggaggagcaagtcacatcttacatggatggcagcaggcaaagagagacagcttgtaaatggaaactcccatttttaaaaccatcagatcttatgagacttattcactatcacaagaatagcatgggaaagacccacccccatgattcagtgatctcccaccaggttccttccacaacacatgggaattatgggagcttacaagatgagatatgggtggggacacagagccaaaccatatcagcatcctactctccttttgacaatggatgaggcagctgaaaggaataccaaggagaaaggggaagaatgcagggtgtggcctattatgactttgggcaaacgcttaacctctttgagcctgagttttcttcctctgcttcacagataaatatctacatacaggggtgatatgaagattaattaaataagttgaaatgtagtggttaagagtggtaagtccaaatctcaaactgcacttagttactaaataaccttgggaaagttacttttgtgcccagtttccttatctgtaaaactgacataataatagtgcctacctcccagaattgttgtgaagcacagaattgttctaaagagcgaagcttagcatatattaagtatttgataaatattggctctcattatttttgctatctaggactcagcatcctgaaaatagagaataccccttcttttcacgtgcccattggacattcacaaaaattgagaatttattatgcccataaaaaaacctcaatatattgcaaaaagtagagtgtgagcagcatgttctgagaacagttctgtaattgctgacataagtaactctctaaatcaactcttgggtcaaaaaggaaataaataaattacagaacaccttcaaaataacaataatggaaacctcatatactagaacttatggtctgcaactaaaggactttttagtattacttgtgaatattgatacaaaaatactggataaaatatgagtaaacaagatccaccaacacactcaatcatttaccacaacccactggacatgcccatgccctttcaaaaatataagtatatgatccttgtttggggtaggggacaggaaaactctcaaaagcattcttgggacagtggaggaaattaaaatatggactggatagtaaatgtttttccaacaattttgttttagcaaattacatccttatcacaacaccctataaaccaggtactatcattggccctgttcaacagataagaaaactgaggtgcagaaatatatagatatagatatagctagataaagatagatagatagatagatatagatatctatctatctttttttttttttttttttttttttttttttttgagacggagtctccctctgttgcccatgctggagtgcagtggcgcgatctcggctcactgcaagctccgccgtccgggttcacgccattctcctgcctcagcctcccaagtagctggtactacaggctcccaccaccacgcctggctaatttttttgtattttttttagtacagacggggtttcaccgtgttagccaggatgttctcaatctcctgacctcgtgatccgcccgcctcagcctcccaaagtgctgggattacaggcatgagccaccgcacccggccgaggtgcagaaatgttaatttgcagatggacacataggaaatggcgaggcgaagaaatgaacccaggcaatctgagcctataaagctcttccttttaaactctacggggtactctctgagccattctcagctacaaaagagggttagtaattcttatctcttgtggtggacaaggtaagatacggagttgagtggggagaggcattgatgctatctttatctgtttctgtattgttgagttgttataatgagcatgtattattcatgtattttttcatcaagaaaatgttttttaggggcctataaaagtgcctggcacaaagaagctcccaataaaaacattattatgtctgaaaggaaattcagaatttccatttgacttaataggaattcatcagctccggaagctgggtgaagaaaagaaacaagatagggcaacagctagaggagaattcaggtgagaggtttctactttcaaatgagaagggcttatacatcctaaagtaaggggtgggaacagaaggagggagaaggaattgggagctgggggaagagtggtcctaaagcctccctagatgaatttaattatttgggggaaggttactagtgaccaattgttgacatatatataagccccatttcatacatgccatgaataataggcctccctggggtaacaaaaatttaaagatcattctggaaaatgagacaggaattaaaagaactctatggcttgctttctttatctacctggttctggcaatgtgagaataggttttctgaagaggagccaatagtttgtttttccacttgtgggttacaatggtaaaatgattgttggcaaaagaacatcttttcaagcagcttcccttggtgtaggtcagaggggcaacaagcagagttatttctgcagctgggaaaaaggttcagagctatcttcctagaatcggctcttgtttcagaatctaaaatagatttgaaatattgtgctatttgggaattggggcctattcatgctaagcacatctgtgggtagctgttgaaattcaaataaattcaaataaagtccaagtaatgctcatactacacttaccaatttcaaattttaaaaatacatatatacaatacctgcaccccatttggtatcactacctaagacacaatatggaaagccttgattttctgccagccatagctgctttgaacctgaaccacaacatttaattcctttgaaaatgccccttcctccctacctgaacttttcaactgagattcattttcaaaagtttaaatatgaactatagcaaatagttctatattttggttttgatcatttgacagactttagtagctgcaatgaggttgttggactacttaagtcataaagccaggattgaataaatgcattttccttctcgtcatctttctgatttcagtaaatacagtttacttaggtgtggtgattaaggaaacctggtcgatttatttatacactattccattccatattcaaggtgtcttttaaaaggcaaagtaagggaacttgcctttttaaatttaaccatgactttcttatagtgatctacccaatgtatggaaagaagtagaactggctgggtgcagtgactgacacctgtaatcccagcaagttgggaggctgagacaggaagatcacttgagcccaggagttcgaaaccagcctgggcaacatagtgagacccagtctctaccaaaaaaaaaaaaaaaaaaaaattagctgggaatggtggcatgcgtctggagtcccagctacttgggaggctgaggtgggaggatgcttgagcccaggaggttaaggctgcagtgagccgtgttggcagcactgcactccagcctggagcaagacccctttctcaaacaaacaattattttaaggttgtgagtttttcttttttttccttaatagttaaaaatttgaaaggcatttaagtgacatattcatgtcataacctgagagtttacaatgttataagtaggtaacacattaagcacattatatgaattatctcttaatttaaacctcataattacccaatgaagtttgtgtcatcatttccatcttacttataaatgtatccaaggcttacaaataagtaatttgtccaaggtcacacactcagccaggagtgaaactgtgcccattattcaaattattaactgttttgatttttattattatttgtagagacaggggctcactatgttgcccaggctagtcttgaattcttggccttaagcgattattccaggtcagcctcccaaagtgctgggattacaggcatgagccactgtgcccagcctgagctgttaactcttaatctaaacaatgccttttacatgagaaacagtaaacaagatggcaagggatggcaaagaggatactgaaatatgttaggagctacatacaagaaataaattcacagttaaaagatgaagacctttatctaaatccaggcaaactgcaaactttaaaaagaattatgataagaataaagcatcaggaaggagaaagacaaactgatgacactgatatcccagaataaggccccatagacaaaggtataaccatcatcacatatggttggtgactcccacagcgtgttcctcaccttccccagtgcctttgggaaatgtgagtgttctctgtaaaagttctggcatggtgaaagatcgtaactctaggaagctgaataacttaccatttggcactaatatccctgatttcttctgtttaacttttttgctctcatctctatgttgaaaaatgcaatagatgttaaaatcagtaataatgttcaataactagtacagctgttcccttgttccacctcaattttatttatagaaaagccattattccactattctatatcaataacaattttcatttgtttttctacgtgtataatatgaattatattaaataacaaattttccagtttccataataataattctaatgactatataacagtctgttgagttgatgcactgtaatttatactgggtattttgtttccagttttttgctattataaatatccttccaagaatttatttaggcatctaatttacttaaatttcttcatatgcaaatagtatgtttatgtcctctgaccatttatctcttgaggttttaatatttttgaagatttggataagtccttaatttgttatgtatactaacttcttccctgtttcctaattatgtttcccttcttgtgtgtttcaatcattgttagtttttttatgttaaaatcactttttcttgatgtttttaagctatttttttgtgtgatttccattgttgccataagcttttcaaaaatgctgtctaaagatttcacagatatttgatgcatatttctcctagtttgctaaaaattaaaggatatagttaactctttaatgcactatgatcttactctgctatgtaccataagtgctaatttaaattactttttgtttttgtgttttttagccagttatcctggcaattattaaaacataattagccagacatggtggcacacatctgtagtcccacctgtttgggaggctgaagtgggaagatcatttgagctcagtagacgaggctacagtgagccatgatcacacaactacactccagcctgggtgacaaagcgagatatgtctcaaaattttaaaaataaagataaaaaataaaaatgaatacaatgaataaaatgtaattactaacttattttttcctaattttatgatagtatatgttgaatttatttctacatgtcttacactgctttattcaattagtgtaataacttatactttaggttttaggatttcctggggaaattctggagactagagcagcatcataagtcacactttctttgttagtgtggaatttcaatatttaacaaacagtaaataacttcacttggtgaacattgtttttctgtataatatatatctaaatctgtttatcttgttttgtatagtccattaaagctttgtacttttctttacatatggcacatacaattctttatcattttctttataaatgtcatggtttgaaaccacgtttgcagagatgataaaagtgagagactgaggcaagatgcttcttgcctcacaggtggtgctccttgctcattccagggcataggccaagctcactatggaagaaatttagtttatagtttgactttgaaccaaggatgataatagtccctccctaagactgatcccctccttgtccgggactgaagccacctttgtaaaactaatgaaaggccacaagattagtattatgggaggagcctcaattctgctcaaatgtaggcatagtttctataatcccttactgctcagtactcatgtggccagaggtcacaagatttaagacttccccaattgcgcccatagataacatcactattgtagaacctacgattgggtttttgagatgttttttcacttttgttttctggcaactgactgaccatatccaaccagtgactcatgactcaaccagtgtgtcctgtggccccccacccaaaggaggactcagcacactgggatcattttccatacccctgtgatttcatcccaaatcaatcatcggcacccattccctatccctctgtgcaccaaattatccatacaaaccctagccccttatcagagagactgatttgagtgataaccccagtccttctgcttggcagccttgcattaattaaactctttaactgcaataccaggacctcagtaaagtggttttttctgtgtcccctccacccttttttgtggctatgttaaatgggatttcttctctttttgttaaactagtggttaccacaataaagaaatcccctaattatagtgaattcactataaacctagtcactttgataaactcacataggctaataagcaaatttcttaggatttttagacatgcattgctttctgcaaataatcatagttttctctcaccccttaatgtatcattctgttgtcacgaagtgaatgcagttgccattattcctgtattagagtgctaggctggaaaggcaagaaacatacatgttactttcagttcctcaactgaggaagccattgatgaagcaccttcttttcatggatcaagcaccatgctaaacacttcatatcgaccatcttgcccaaggctgagaacaagcctaccaagtatacaattattaaatatcagtgttgaggaaactgaagtttagcagatgcaggctgcccatgttaggccccaagaagcaataaaaaatggaacactgaggggcctaactatgggggtctgtgaatgaaaggctgtgagtctgtgtctctgggctcctgtgactggcaggtttatctctacccaggagctgcattgaccatgaactttggccagtgatctatgaggaactagggagggatctcagagctgaatccgctcgcctgcatctgtgtcttgtgcatatgcttcacacttcctgtttctaggtcatagtaagtctaatgtgaaagtaatcctgaaggtagtctatgttcttgttttcactgctctccaacccatcagccctttgaggttaatttatctcagatcttagaaatagcaaacgatggagtaagtggcttccttcacgaccagtggtctttccattgtaccaatgatgtcctcatccaaatgtaagtcagataagatgatccaattttgacaggctgactgttcctgaatatgcattatacaaattctcacagaggctatactgtccacatccttgagttgcttatattgctttgcacataacaagtattcaataaatatttgttgatgcagaatgaatgaatgaatgaggcaaagacaacagtcttaatgcttttcctacaagagagactttcaatgatagaatacaaactcatgtggtatctcctaaaaatctcaccatttcacatttcaaatgtggaagcttctataaagactgtatttgtcatgagccttttcacaagaagatgtttagtaccaggtcagcttgttttcatcttgttttcaaagaattggggttaggaaagcaggaaactaggaaggatcaaggtgggaacagtggtaggcaggcttttctctgacaaagttgtttgggttatttttatctttctgcttctgttacagcaacaatatgagaaaactgactgttcaaatttaataaatagagtctgtccaaacccaattttgaacaaatgacaaactatggtgcacatgcattaacatttctgtttgggtatgcaatgggaaactaagtcttatgttctcgtctgtaatttaaacatacaaagttttaaatgttccattagaagatatactacaatactagtacattaattgagtgttctttgttatgccaaaaaattccaaaggaagttacacagcccctagaaggcatagaatctgtagattttgtaattatggtttttaaacttaaaatctcattgaagtcattagttaacatttctaaactttttgtttgtttttgttttagacagattctggctctgttgccaggctggagtgcagtgggacagtctcacctcactacaacctctgcctcctggattcaagcaattctcctgcctcagcctcccgattagctaagattacaggtgcccaccactacgcccatctaattttttatatttttagtagagatggcatttcaccatgtttgccaggctggtcgtgaactcctgacctcaggtgattcacctgcctcgacctgccagtgttgggattacaggcatgagccctcgcacctggccacatttctaaacttttatgcctgaataattctgaacagatattccaataaccttcctgccctccacctcatcccagccaaagccgggagagagggaagacctatactaccaatagttacaaacaattatttttggaattaaaaacaggaatttgcaccatgaacaagtgtctcgttttgtcttctgagcttctcaaaaaccaccattatattgagactataaaattgttctttaggctgggcaagatggcttatgcctgttgtattagtctgttttcacaccgctgataaagacatacctgagactgagcaatttacaaaagaaagaggtttataatggacttacagtttcacgtggctggggaagcctcataattatggtggaaggcaaggaggagcagtcacatcttacatggatggcagcaggcaagaaaagagagcttgtgcagtaaaactcccccttataataaccatcagatctcgtgagacttaccattgcaagaacagggcaggaaagacctgcccctataattcaatcacctcccaccaggttcctcctatgacacatgagagttgtggagatgagatttggtaggggacacagccaaaccatatcaactgtaatcccagcactttgggaggctgaggtgggaggattgcttgagcccagaggtttaagaccagcctgggcaacatagtgagcccatttctacaaaataaaataaaaaattaaccaggtacggtggtgcacacctgtggtcccagctagtgggaggatcacttgagcctgaaaggccaaggctgcagtgagccatggtcacaccactgccctcaggctgggtgacagagcaagactccatctcaaaaaaaaaaaaaaaaaaaaaaaaaaaagttctctgaaactaaaagaaaaatctagggaaattaaacattttttattgcaaatcacttaaccttagaatgtcaaagattttccctaagtttttatataaaaagaagcatgggagagagccatagggaatcaaaatttatgagccacaatatttgcaagaagagaaaacattacatcagccatgcacggtttctccaacatggatacaaagcagaatgatgtaatagcagctgcagttttgtgctaccacattaaacagtggtgcttttgatatcatttaactaaaccaaaatatgcagttcaacctcacatagctcaaaatactcagttcaacctgagatggtcctgaattaactagaccatgtttcaggcttctgaatattatttttaagttctgtgtaaggtaaggtataaaagaagaaaaaaaacctccttgcctcaataactttggttttaataaatgcaccaataaatttatttgaaccctgagttaaaatgattcagctctagtggatgaccaaattgaggctgcttttctttatttattcaagttagatttcatgtaaacccttaaattgtatgaattcaactatcatttctaaagcagccagactaatatgaacctaaatctgagtatacttttccagaaacagctgactatttaggtctcgttatctgtcctgtatctcactatcttcttcccaaccacaggaaactgaggattggctactgactatttgaaattggctatttcatagaggtaaaaatctcatcagtatgctggcaacagtctttaattttgaaagaggaatagtcccacttgactatttctagcttccagtattaggtcaggagagaaaacatttctttagaaccttttccataaaatcagggaataatttaggaatggggaaatcttctagtgttttatttcagctctcctagggatgtgcttcccaaggctttgacagggagaaactgatagctatcagtgtgaatcagctttgtgtctaacaatttcctttctaaggaacatcaagcatagagaaatgattaagcatatttatataatctaacatattaagtgaattacatttaggtgaaattggaaagtcagcacgtattgctttataatgaacatccaagccctgcttgatttgcctaatggactatttgataagggcaaaatacattctgatttaatggaatttctaattagttaatatttagtcaaagtgcaacattaagcgtatccctaattatatgtatgataggagtttacaaagcaattggtatgggttttatatttatatttatatgtcatatatctttttctgaaaaaaagttgaaactagaacttaaatagcttacatgtttatcctttctatccttgttaggaaaaattcctttaaagagattacaattattactgtaccccgataatcattattatccttgtgcttaattttcatt

SEQ ID NO: 171 - DNA, 9930 bp, Homo sapiens
ccagggggtattttggaaaacagtaggagcacttttctattatcacatgtgattttctttattcagtctagtaaaagttgaggtatacaatgttataaaaaaagaaaaggatgttgggtgtgagggtgttgagaatcactggatctatattatatgcaagttgctgaaaaaaaaaacaaaacactagttctgtgtacttggaaaatgcttacatctggtgggacaaatagaccccactgtgtagcagccaagtctggataaagcccttttaaagttatcacttgggtcctgataggcttgataagggacctatcagatgggtcagataaagggccatctattcccaaaggcctaagaatgcttgacatttaaaagctacacgcaattcctgctctcagagagcccacagctgaggaagagactgagacaggtaaacaaatttcaaatctgtggccacatttacttaaatgatctgagacacttatagagtactaggagagttgaaaaagtcaactgcttttaaaacttaagacatgtcattgaggtgctgagccctggcgatcttccacactgcatcgtggatcttaatcagctttgttatagatggcctgagccaggttagatgaggatgcaaatcaaaaagcagggacaatgagtataatgtggcccttccttttcccagtattactagctcattgctacactctttgcaggtgtggcccactttctttgagagaccccttgtgaggaaagcctttgagaagaccctcaaggacctgaagctgagctatctggacgtctatcttattcactggccacagggattcaaggtttgagtgactccctttctcagcctctagtttctgagctgttgcaggaattcagggacccccaacagagagactggctgaagccatggcagaagaacataaattgtgaagatttcatggacatttcttaattccccacattaatgtttttataatttcttacgcctgtctttactgcaatctctgaacataaattgtgaagatttcatgaacatttatcacttccccaatcagtacttttgtgatttcctatgcctgtctttacttaaatctcttaatcccatcatcttcgtaagctgaggatgaatgtcgcctcaggaccctgtgatgattgcattaactgcacaaattgtttgtagagcatgtgtgtttgaacaatatcaaatatgggcaccttaagaacaggataacagcgatgttcagggaacaagggagataaccttaaagtctggctgcctgtgggccgggcagcacagagccatatttctcttctttcaaaagaaaataggagaaatattgctgaattctttttctcagcaaggaacaaccctgagaaagagaatgcgctcctaggggtaggcctctaaaatggctgctctggggacggctgtcttttacagttgtagataagggatgaaataagccccggactcctgttgtgctcccaggcttattaggacgaggaaattcccacctaataaattttggtcagaccgattgtgtgctctcaaaccctgtctcctgataagacgttatcaatgacaatgcatgcccgaaacttcattagcaattttaattttgccccggtcctgtgatcttgccctgcctccatttgccttgtgatattttattaccttgtgaagtaggtcatctctgtgatccacaccctatttgtatactccctccccttttgaaaatcactaataaaaacttgctggttttgtagcttgagggcatcatggaacctgccgaaacgtgatgtctcccccggacacccagctttaaaaatttctctctttgtaatctttccctttatttctcagaccagccaacacttagggaaatagaaaagaacctacatgaaataacgatgaattatcaggggcggattcacccaatactgagcaggtgccagaaagtagtagctgcaccagggctgcagagtggtgtggactggagcaggagagcttgcacttcataattgggaatggcaggtggtcaggaagagaccttggagcagaaagatgctggctggaagggaggctaaggccatgtgcgctgctgaggtgctcacatgcctgggttatcttgcagttatgtctgagagaagacatgatttctggcagcccagacaagttgtaactgccatatcacctttgtctagattccatgccctggggttgccctcccaggaaacctcttgggttattcttccataactgtattccagggcttaattattttattaagcaaagcacacctggcagtggcatcttggagaaaagtccaagtatggtgatgctggaaggaagccagtagtgatcccagcacccattgcctggggctctgctcttacctgctcctgaggggtgggggagacaaatttccagctctctcccctcctgaccagctggagtgatgatggcctgccatcccgaattccacgcctcttctagaggctgcaaggatagaagttggccaatatcttctccagaaaaccacaccctggagatctaatctttatccagtgatactgaaatgaaagtttgcccttgggtgtgtataggatgtaggtgtgtgaggttaatgtccatggtgataatggtggcttctggaatgtactaacagaggatcttaaagtcaatccagtagtttctaaaaatatagggattaatatgctacagtagatatagagattttatttaaactcacattcttgtagtatgtactccagagcttgaaaaagtggtatgcagatgtggtatttagcaagcatcaggatcctgaaaccttgttgaacagaaccaagtgtcctgatgcagattccagtaaacttttcattctgtatttacagactggggatgactttttccccaaagatgataaaggtaatatgatcagtggaaaaggaacgttcttggatgcctgggaggtaggttccagctttgtctaagtgtgctgggagagaaatcctcagttatccatgagattcccattgatatgaaagaggccatgtgcctgatgctttctaatttcatcattgtgattctctagctcttctaatatcctcctcatcacctttggcttttgggtgcatctgatactatttatatttcaagcctactactgagtcttcaaataagactggaaatacaatgtaccccactttggggaatacacatgctgttctcaaaccagggtgaggcatttggaacagagggtttgggcctgggtttgctcatagcagctgagtaacctagggtcagttttgtaactcttgtagggctcagttttctctttaaagaaaaaaggtcttataatacatactactaatatatatctttcggggtgtgataaaacttaagatggtttacgtgccgggaacatcagtcataaagcccatgtaatcatctaaccctaggagacagggttaacatccccatttataaataatgacatttgaaacctagattggttggtgacttgcccaggtcatgtcacaatgtgtgtggcagagctgggattagacccagactcatctgaattgcaagtccaaccaccaaaaccatcagcatggtgcttggtaagcagtgaacacacatccggaaatcagggaactttgtaatcccagcactttgggaagccgaggtggaaggatcatgaggtcagaagtttgagaccagtctggctagcagagtaaaacgctgtctctactaaaaatacaaaaaattagccaggtgtggtggtgtgtgcctggaatgtgagctacttggaaggctgaggcaggagaattgtgtgaacttgggaggtggaggttgcattgagccaagattgcaccattgcactccagcccaggcgtcagtgcaagacaccatcttgaagaaaaaaaaaaaaaagaaaaaagaaaatcagggagcctgagtgccctgcttctcagatcaaacccatgacctgtttcacatcatttcatattgaaaatgaattaagggatgaatgttttctctggccattttttattataccattatgtccttttgcaaatgctaatagagaacgaattggagaaataagatataaatgaacagtggcatataactccaagagttaatcatgttatcttggcagctgtctgtgtaggggtgcatgtagttgcgagtttgtattgtgttttacacgggaaaatatattaagcctcacctttctgaaatgcttagaattgacatgattcaattaaatgtagttttttctgtgtattgtttgttcaaaagcattaatccacaagcacagcattctttttttgatacagattctcactctgtcacacaagctagggtgcagtgacaccatcttggctcactacaacctccctctaccaagtaaaaaccattctcctgccttggccttccaagtagctgggactacatgtgcatgccaccacacatggataatttttatatttttagtagagatgaggtttcaccatgttggccaggctggtctcaaactcctgacctcaagggatccacccgtctcagcctcccaaagtgttcagattacaggcgtgagctatagcaccaggctgtttgcattacatttgatctgtgtttttgccttagctcctatgatgatatgaagtatggcaagtatgtcaatgtaccctgcttctcacagtgctatgttttcttaatgaacatgaggatgactgctaaagaaaacatttgaaaggcatgaaaagatatcattgatcaagttcagaggctctgatttgaaacgagcatgcttgaatacgtaagcattggatgtttatgtagacccacaaccagttcagtagaaacctcattgactaccctgaagcagaggggaggaaaaaagtataaagaagtcaagttttaatacgggaaaactaacctgacctatgatgcacaaaagcttttaaattatctaattgctgaatcagaagtttttgggaaacttatgatttcatagcttccaaactctacttcccaatttgaataacttaatctatgctagtggttctcaacgttggctgggcattagaatcacctgaggaatttaaaaatcccaatgtctaggctacaactcagacaaaatcagtaagaaactctgggggatgaaatccaggaatcagtcatttttcttttttaatttagagagagtcttgctctgttgcccagagtagagtacaatggcatgatcatagctcagtgcagccttggactcctgggctcaagtaaacctctgaagtagctgggatcagaggcacacgtcaccgcatccagctaattaaaacaaatttttttttttggtagagacagagtcttgctatgttgcccaggatggactcaaacatctggccttaagcaatcctcctgtctcagcctcccaaagtgctgagattagtcatgagccactgcatccagccagtacctttcaaagctcactagtgattccaaattgcagccaaaattgagaagggctgcataaagtgttccctgaacatgtcatgctcatccctgcctctgagctttgctcctgccttcctgccttcctgtgtcatatgctcatgtttttcccctcttttctctctctcggggtttttgtttgtttgtttgtttgttttttgaggcccagcttatactctacctgaaaggactcccctgacaactgcgggctgtgtgaatctcttccttctctgcctttctgactctgtctatgccactgtcatgttatctgaggcagcctcagtgtcatgattgatggctccatagaagggaactctagcactttaattggactgtaagaatcccagaagaaggaagcacattgtatacttttacatcttgacaacttctgggcaggatctagaacatgtaatagatggctactaaatacatgttgcattggaggctgctgctaacatatatgatatctttgggcaagtttggaaaatgcccaataaaggctaaaaattatacaaagattcccttccttgcatgtccatgcagcttctgtaccaggaagcatggctggatatgcaaacagtgggtcaggttttagccccacacaactccgtggccgggtgcccctgctagggcgtaatttatatgcatgaccttcttgcaaaccaagccatggttggtgtgggagacagtgactcaggacccacaggtgaggcttctccgtatgctgcagcctcttcctgactaacacagcttgcccaggtttgggtgtacaatgtacacacacaacagtagctccctgctatcatttggattcattaaaaattaaatcatctcataagcttacaaatgttgatttttatttatttttttcatgataaaactttcatatttccatggtgtatggaactataattttttatgtgtttctttacgtgtaaggtgagagtggcaagaacataaaatctttacctgttagttttagattttcttgggctggggaggggcagtagggctggaaccaatcactgatgggcacccaggccctggactgaaatttcctgtgaatgcttcagctaactctgttgcggtggatcctttagcaatttctgccccagggaagactaaggcaagccagggtccctgtagtccctctagagctgcccataaggtattcctttctatgataggccatggaggagctggtggacgaggggctggtgaaagcccttggggtctcaaatttcaaccacttccagatcgagaggctcttgaacaaacctggactgaaatataaaccagtgactaaccaggtaaattctattcagtttaagggtaagggtcctgccctattacttcttaaacattgcggggggaatgttcaatgctatgccctgagtcttatctcaggggtcagtgatcaggacactttggggaggtgtgaggctgatctcatgggtgatttagcaagaatctcagtgcgcacttgtttggcctttgcttggtggactttttttgtgtgtagaactccctaggaacaatgcaaaacagagccggctttccccgtgatgaggattgtttgctgttgcaggttgagtgtcacccatacctcacgcaggagaaactgatccagtactgccactccaagggcatcaccgttacggcctacagccccctgggctctccggatagaccttggtgaggcttccaagtggtgggtctttctcttgataatcttaaaaacattattttataattggtaaatgtcggtatgggtccataagttactggaaagaaaaatgtgtgtaaggtaacacgtttggtacacacaaatgggatggcagtgggaaaaaatgggaattaaacaacaacaacaacaacaagggcgacatgcttgaccctctgggaatatttccagttcagccacccaagggtgaaccaggcttgcaaaatgctgaggcttcagagcccggggaaaggacccaagcttccaggtcctcctgcctgtctcccagatggagaggctctgatgatcagtcttgagaccctcattggagtggtgtccttctgtacacggtagccatggtgattattcacatcagcatctttctgcccctagggccaaacctgaggacccttccctgctggaggatcccaagattaaggagattgctgcaaagcacaaaaaaaccacagcccaggtaccatatttttatttttcttgttatccaaccactcatgcttccagtctcatgtttcatttctcgtgttgtcctcaactgactccttaaaggggaagaacacaggagctgaagccctctaaagtatttcctttgaagtctgttggaacctctaggaaacacaagagctgtcactgaagcaaagatagcttctgtctcacagcttcctgtcaagccctacagcccagtggcaaagcatggctttggagtctagggatatgggtgcagatgccaactctacctctgatcagccttatgacccccaagctactttcttcattcctaaaaaaggaagatcacagggttgtctctaaggtgaagggagagaaagaggtgggggtctggcacaagtctaatagctgtgaagggctcagtaattattagcgattgtacctgaagccacagtgagctgcagagatgttttattcttcctttccataaaaggaggggtccttgtagctgagtggaaacatgatgtcccctttctgcacaggttctgatccgtttccatatccagaggaatgtgacagtgatccccaagtctatgacaccagcacacattgttgagaacattcaggtaagtttccggctggtcgggcctggtattcctcagtggagtgggggacaggcagaccttctcactaggcttctcacctcatccctgcactgtctttggccccctccttccccaccaccctatcattttccagcccagggagctaggctcggtagagctgagatgaatgacccatgggctaagaacatcctgggggcagtgcctggtaaagccctatcaggtctgagcacagttgtgcctcacaccactgagaagaccctcagttgcccctgagcagctaggccctaggccatacacaagagcagactgtcctggcctacctgctcacctcccagcagcagaggaggtgtgaactgtccttggagaagtgtcctctagaagcacctgtcatggagcacagggcctgtgcacgcctggggtttagtgcctgtgagcctggtctccctccccccagaacactgagcactacaaatactgtggtctttgtgtaggacctaatttagagaaaaatttgtatcccttggacagaatgggaaaaactcctatggccagtttgtgctgtgaatgtgagctccctccctgctagaatggccggcagtctccagccacagcagtaacagccttaccgataatgtattggaattctttcctttctaggtctttgactttaaattgagtgatgaggagatggcaaccatactcagcttcaacagaaactggagggcctttgacttcaaggagtaagtggcatggagttaactagaagaattgccaggagtttttctaaactggtagagggttagttggaaggattagaaggttgttgggactacttgtgtcttcaaatactattttggggcagttttgaaagttaaaatttgggtacctgggaatcactgtaagggacacatctctaattgctgcttattgtctgaacttctggatgtagagctagaattgtaagagaaggtgtgttatcaataggcaggaggcagaacattcatttattcattcattcagtcaatatctagtggtcatctgtgtgccaggcattttctaggtgcttgggttatcatactgtacaaagctgctgcctccacaggcttagggagggagggaagaagagacaacagaaataaatcaactcaaaatattgatgtcagacagcaacaaatgctagacagaaaagtaaagtagggcaaagtggacaggaagtggtaggtggtagtgggactgatcctttatacgggttgggtcaagggaagctttgctgtgagggatatgccatatgtatatttgggggaagagcattcttggcagtgataacagcaggtgcaaagtccctgaggtgggattgtgtttagagcattcaagcaagaaggccagggaggctggattaaatcatctccaaatgcctcttaaaggaggtggtgctaactttactttaaatctcagataagttgttgaaaaaaagtctttcactctggctaggcgggaattctacatcatctctttagaatcaatactttctgattaatgtgtctaattacatatatcaaatagaattgtctggcatttattac

SEQ ID NO: 172 - DNA, 3706 bp, Homo sapiens
cagaggatcttaaagtcaatccagtagtttctaaaaatatagggattaatatgctacagtagatatagagattttatttaaactcacattcttgtagtatgtactccagagcttgaaaaagtggtatgcagatgtggtatttagcaagcatcaggatcctgaaaccttgttgaacagaaccaagtgtcctgatgcagattccagtaaacttttcattctgtatttacagactggggatgactttttccccaaagatgataaaggtaatatgatcagtggaaaaggaacgttcttggatgcctgggaggtaggttccagctttgtctaagtgtgctgggagagaaatcctcagttatccatgagattcccattgatatgaaagaggccatgtgcctgatgctttctaatttcatcattgtgattctctagctcttctaatatcctcctcatcacctttggcttttgggtgcatctgatactatttatatttcaagcctactactgagtcttcaaataagactggaaatacaatgtaccccactttggggaatacacatgctgttctcaaaccagggtgaggcatttggaacagagggtttgggcctgggtttgctcatagcagctgagtaacctagggtcagttttgtaactcttgtagggctcagttttctctttaaagaaaaaaggtcttataatacatactactaatatatatctttcggggtgtgataaaacttaagatggtttacgtgccgggaacatcagtcataaagcccatgtaatcatctaaccctaggagacagggttaacatccccatttataaataatgacatttgaaacctagattggttggtgacttgcccaggtcatgtcacaatgtgtgtggcagagctgggattagacccagactcatctgaattgcaagtccaaccaccaaaaccatcagcatggtgcttggtaagcagtgaacacacatccggaaatcagggaactttgtaatcccagcactttgggaagccgaggtggaaggatcatgaggtcagaagtttgagaccagtctggctagcagagtaaaacgctgtctctactaaaaatacaaaaaattagccaggtgtggtggtgtgtgcctggaatgtgagctacttggaaggctgaggcaggagaattgtgtgaacttgggaggtggaggttgcattgagccaagattgcaccattgcactccagcccaggcgtcagtgcaagacaccatcttgaagaaaaaaaaaaaaaagaaaaaagaaaatcagggagcctgagtgccctgcttctcagatcaaacccatgacctgtttcacatcatttcatattgaaaatgaattaagggatgaatgttttctctggccattttttattataccattatgtccttttgcaaatgctaatagagaacgaattggagaaataagatataaatgaacagtggcatataactccaagagttaatcatgttatcttggcagctgtctgtgtaggggtgcatgtagttgcgagtttgtattgtgttttacacgggaaaatatattaagcctcacctttctgaaatgcttagaattgacatgattcaattaaatgtagttttttctgtgtattgtttgttcaaaagcattaatccacaagcacagcattctttttttgatacagattctcactctgtcacacaagctagggtgcagtgacaccatcttggctcactacaacctccctctaccaagtaaaaaccattctcctgccttggccttccaagtagctgggactacatgtgcatgccaccacacatggataatttttatatttttagtagagatgaggtttcaccatgttggccaggctggtctcaaactcctgacctcaagggatccacccgtctcagcctcccaaagtgttcagattacaggcgtgagctatagcaccaggctgtttgcattacatttgatctgtgtttttgccttagctcctatgatgatatgaagtatggcaagtatgtcaatgtaccctgcttctcacagtgctatgttttcttaatgaacatgaggatgactgctaaagaaaacatttgaaaggcatgaaaagatatcattgatcaagttcagaggctctgatttgaaacgagcatgcttgaatacgtaagcattggatgtttatgtagacccacaaccagttcagtagaaacctcattgactaccctgaagcagaggggaggaaaaaagtataaagaagtcaagttttaatacgggaaaactaacctgacctatgatgcacaaaagcttttaaattatctaattgctgaatcagaagtttttgggaaacttatgatttcatagcttccaaactctacttcccaatttgaataacttaatctatgctagtggttctcaacgttggctgggcattagaatcacctgaggaatttaaaaatcccaatgtctaggctacaactcagacaaaatcagtaagaaactctgggggatgaaatccaggaatcagtcatttttcttttttaatttagagagagtcttgctctgttgcccagagtagagtacaatggcatgatcatagctcagtgcagccttggactcctgggctcaagtaaacctctgaagtagctgggatcagaggcacacgtcaccgcatccagctaattaaaacaaatttttttttttggtagagacagagtcttgctatgttgcccaggatggactcaaacatctggccttaagcaatcctcctgtctcagcctcccaaagtgctgagattagtcatgagccactgcatccagccagtacctttcaaagctcactagtgattccaaattgcagccaaaattgagaagggctgcataaagtgttccctgaacatgtcatgctcatccctgcctctgagctttgctcctgccttcctgccttcctgtgtcatatgctcatgtttttcccctcttttctctctctcggggtttttgtttgtttgtttgtttgttttttgaggcccagcttatactctacctgaaaggactcccctgacaactgcgggctgtgtgaatctcttccttctctgcctttctgactctgtctatgccactgtcatgttatctgaggcagcctcagtgtcatgattgatggctccatagaagggaactctagcactttaattggactgtaagaatcccagaagaaggaagcacattgtatacttttacatcttgacaacttctgggcaggatctagaacatgtaatagatggctactaaatacatgttgcattggaggctgctgctaacatatatgatatctttgggcaagtttggaaaatgcccaataaaggctaaaaattatacaaagattcccttccttgcatgtccatgcagcttctgtaccaggaagcatggctggatatgcaaacagtgggtcaggttttagccccacacaactccgtggccgggtgcccctgctagggcgtaatttatatgcatgaccttcttgcaaaccaagccatggttggtgtgggagacagtgactcaggacccacaggtgaggcttctccgtatgctgcagcctcttcctgactaacacagcttgcccaggtttgggtgtacaatgtacacacacaacagtagctccctgctatcatttggattcattaaaaattaaatcatctcataagcttacaaat

SEQ ID NO: 173 - DNA, 65642 bp, Homo sapiens
ctttctacttgcatgcatcctttgcttacctcatattttgaaggatacctggcttcaaagacagtcgtcagggatacagcacccaggcatctggtcccctaggtcaagctcccttgctggcctccttcctaaccctgaagcagggcagagaaagaaagaaaggcaaggacttcatcagggcctggctgctcctatgaatgagccatctctgtcacaggcacacactctctctctctcacacacacacacacacacacacactcacaccaccactatcaggtaccttctgccgtgaggagcagcagccatactccaaagcataaatgccaggtgggcagcagggaggccgaacacctgctcctctcacctctagtgcatcaggccctcgacctacgtggccttgttccatgttcgcatccggcctgtgaggtaggactgacgaatcctgactcagaggaggaagcaggcccttagaaagtgttgagagaccagagtcacacagcacccagtgttcccaagcctgacaccaggtccacgattcttccaccatcacacagagggagtgcggcacagttcaggccatgggagcaagccctgccctttggggagaccggtgagcagcccctggggtgacagccccgtcgttttctggggccagcccctgtgctgtgggtgggggtctcctttccatcccctgctcaggtagaagacggccttccttgcctggttatctcagcaagcagggctggccgacagtcagccatcacagcctccccatgttaagacaaatgacagttgggagccccaggtccccatgcagatgggattttccacagagcccacactggatctggacttgggctttgcacaacagtaaagtatagaaatggaataaccacaactgtacgtgtggagatttctggtgattatccacctgtcttagttcggatggaatttagggttagggaagaactcttttttttttttttttttttttttgagaaggagtttcactcttgtcacccaggctggaatgcagtggcacgatctcggctcactgcaacctccgcctcccaggtataagcaattctcttgcctcagcctcctgagtagctgggactacaggaatgcaccccctgcccagctaatttttttgtatttttagtagagacagggtttcaccttgttggctgggctggcctcgaactcctgacctccggtgatctatccgccttggcctcccaaagtgctgggattacaggcgtgagccaccaagcccagcctagagaagaactcttgtgttgcaaatgtcttctttgtggatagtgagccaacagagaatcacagttagctaaatagacaactaaccagaaacatatgatgtaaaatactcaagccaagaaaccacatctcttacgtaaaaccaaagtgaaaatagagtgcgcaacagtcctaaaagactgttttaggatgagtattattatactaataatactagtgataataggagctattctgtgctaatttccacaagtattaaattattcattcgcacgacaacactgtggggtggctagaggatgaggaggttgaggtgccgcgcatcagtgcacagtgtgaagatggggttagatgatgcctccatcagcagcaggacttggagccctgctgaagctccatctcccaaggtaaaggcatgcccagttgcaaaagggagaaaaagcaggttccatgaggcctcatgtacaagttggaggagaaagtggctacacagagtgggactagaaaggggagaggggggccgggcgcggtggctcacgcctgtaatcccagcactttgggaggccgaggcgggtggatcatgaggtcaggagatcgagaccatcctggctaacaaggtgaaaccccgtctctactaaaaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaagaaaggggagaggggctgtgtgagttcctgctgaagaggtcggaggtgctgtctggatgctgttagggtcattttatatctacacatgagcggtgctcagcctcaccagggctttagatgtcatggccttggaaggagacgtctctgcgggaaggaaataaaatggaaagcctgtgtcttattgattagaatggtgatgccccaaacacactggtctgttaagacatttgaaacagtttacggcaaattggaaaatgttttataaagttttatataaagatgaatgtatttaatttaaaagattatcctttgtagccaccatgattaagggcagggactctggagcctgctagcctgggctcaaatcccagctcagccaccagatagccacctattgctcagtgaccctgagtgaagcattgaacctctgtgcctcagtttcctcctttgtaaaagggaataataatagtacccatggccttaaagttgttttgagaataaataagtcgatgtggacagcacttagaacagtgcctggcacgtggtacataccataaaagtgtttcatattatccctatgttttaaatgtaaaaagccttatcttggccaggtacagtggctcacacctgtaatcacagcactttgggagatcgaagaaggcagattgcttgagcccaggagttcaagaccagcctgggcaatataccaagaccttatctctacaaaaaaaacaaaaaacgaaattagctgggcatggtggcacatacctgtagtcccagctacttgggaggctgaggtgggaggattgcttgagcctgggaggtcgaggctgcagtgagctgtgatcgtgccactgcactccagcctggggcacagagtgggaccccgtctcaaaaaaaaaaaaaaaaaaatttaagagagaaagagagaaagaaaaagaaaaggcctatattttagaaagtgatagagctgggaggttttctgtttggtttggtttttgttggttggttggttttctcaatgtctttacttgatcattaaaaaaagcagcagcagcagctggtaaccctatttgccctatacttctttttgtactcatctttgatacccagaagtctaagaaatactgatttgtaaagaactgttttacccaaaattgtagcacttttctttgcaacttattttctcccaaacactccagcttcctgagattcctcttgagtgcttagaagagtacctggcttatcagaagggctagataagagttagtccttttattcttgtatatcgattttttttgcatatcttattaggatggatctagaagtagaattgctgggtcaagagcattcctattaaaatggagactcctgtgactcggctgtcttcctgaaacattatacgtggaagtgtccacttcctcacaccccgccattttctatgacatccaagcaggaaaactgggtggacaatgaggtgaggaggtgcagaaattcctgtcgcctcctcccctcctgagctcagaatagtttgggtctgaaagacggctgctccccacagggaggtagaggaggtgagatgcagaggctcgcagccccctaactctcacgggcaccctgggagatcttgttcaaggcacaagatttcacacgctgacggccacaactagcctgcctaaagcagccagttttgcttgaaagatgagctccacttatccagagtgggtgccccactctgggctggggccaagtctagagctcttcgtcttacttggccacagaaagaaaaagggcggaacatgctgaggatgccattgtgcctcttcctcctttacatttaatggaccagtagagaagaaggaatgcgtttcacctttctgtaagtaacacgctcagttcattccttcccagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtgagtgcggcggcagggccctgcccatcacctggtgggcacagagatgaggcaggcgccttgaggacctgtgacctagcccagtggccatggcatccacgtgaagcatgtaaaggagaacatgataagcaggatgggaacaaggagaggatgctgtgtgacagcaccaagcagggtgggatggcctccagagaggcaagctcagggaagactttatggaaggagttaaatttcaaactgggccttaagtgactgcatttgaggggagataggggaaagtatccagggcccagggaacagcacaggccaatcacagaggcagaacggcgtggggcacattgggtgctgccagcaggtgagatggcactgtcacagaaacagggttcaagggctggactggaggtcatgagatggaggtcttgaacatctgggtgaggagccaggtttcatcctgcagtcagtagagagcactgagggctgtgccactagagtgagctgggcagtcgcagggctggggaagactttatggaaggagttaaatttctttaacttctttaaatgtctttggcggcagcagggagaggagagatgcacatctccataggaagcagctgcccttgctcaggcaaaagggatgggaattttttcagggtgatgggaatgggaaggagagatcagggcaagagacttcatagaggtagagtttggtaagatttagaacctatcagagaaggataatgtttaaaaatgattaagcttcccatttaacgactaggaagagagtgatgccagtgatgcagacaaagtgtcaggaaggaaggaaccttagaaatgcaacaggaggaggacccaatgggggtgcctgcggtgttgtcaaaggggacagtgtgtcctgttgtcagcaccagggctggcggaatggtgccccatcaggaccacagaatgacaaattcaaggaaacagaagtgtatggttgacgatccggctcattaaacaccatggaagtcctcaccaatacagatgcagtctgtggaatgtgtgtttctaaaggctattggagttggcaaatcagataaagcatataaatgagatggtgatgctttaggcatccaataacccacagtaccgggtattctacacgggatcgatgcccacttgcgtttgatttctcaaagcctgctccattgacatttgcaaagcagtgggccaggctgaaaataaattggatgtgaaagctgatcacacaatcttggaggtcccaccagacacaagagtcccttccacctcagcctatgagaggctgatgccttctgagaaaaggatggctcggccccattcctgctggcctttctcttgggcttatcttgatctagcactgaactttgtgcccctccgctgaacccccttgttccttcacatgctgttttctctgctgaaaatggccttcccacctccaccctcccttttttccctagaaatcatctttgcccctctcaagcttcacctcacatgtgacctccttggggaagtctctcctaatcctccaggcagctgaaatgtgtctctgccctgagatgtaccctatgcttgatccctttaactctgtgccccgctaaacttcagaagtcgagactgtgtattgccctagaacttggcaatatagcaagatatatttctagaacacagagcctaatgagctcacagtgaattatatttggatgaaatatgtctttcctaaaaaaatgcattatggagttgaagaaattaaacaattctggcttattctaatgtattggtaaaacagcagaggaccaaggtgtatgagcatgttctcctcttattttttttcgtttcctattctagtttcactgactcactaattcatctgtattacaggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggtgggagttattttcctgactcaagaagttctttctttatgtcgtgttcctttctaataatggttttcatagcagatggtcagtatttaggtgtcttcaagtaaatatcataattcctattttatttctagtttcactgtgctaaggttactgaaactgtcccacaaaaagaaaatgattgtgtctatgtggaatgaaccacataaacagtaaatgcaatgagaagaatctcctagtgccttgaagtgaccatatctcgccctagtccatggtagatactaaaaggctttattggctgggcgcagtggctcatgcctgaaatcccagcactttgggaagctgaggcaggcggatcatctgaggtcaggagttccagaccagccatggccaacatggtgaaaccccgtttctactaaaaatacaaaaaaattagccagatgtggtggcacacacctgtaatcccagctactcgggaggctgaggcaggagaatctcttgaatccaggaggcagaggttgcagtgagccgagatcacaccattgcactccagcttgggcaacaagagtgaaactctgtctcaaaaaaaaaaaaaaaaaaagaaagaaagaaaagaaaagaaaaaaagaaagaaaaaaggctttattactcagtcttgaggctcagcccccataatccatgttcatcattactaggttaatattaagactgttgaagtaacatggggctacccccaagtagacactcaccagccctttcacaaataaagtggcatcaaaggggaagggcttcctttcatgtcagaggaggaagcgtatgaagcttaggagcaagggtagacccaatgggattagtgtttcctccaaagacagttgtctcgtagatccagagctgccactgtaatcaccaaccacgttctcccagggcactacagagtaggtattactgaaccatccccactttggccaaccgagttcttcattacccgtgggccttctcgttgtctttgctctaggttattatggttactggtgatcatcccatcacagccaaagctattgccaagagtgtggggatcatttcagccaacagtgaaacagtggaagacattgcacatcgcctcaacattgctgtggagcaagttaacaaacggtaagcacaggagcagcatagtaaaaattccagtttatacccatggggccccactggctctaaagagctgcactacttggaacaaatcagctttttgctctcagagttatgctaggcttgtttgagctattatttgcatatccatgtattcactctaatttcactgagcagctaatatgtgccaggcacagtattgataccatgaaatgaccctttatgtgttccttgtttgaaatttcaaaatccagtgtgccctgggcacaaaacctatgtgcccaatttagaataagaaaaactgaaacaaagggtttatgtgaaattacttgccatagatgcagttgcataatttggaatcgtaagaaccctgtgggttgtttcatgcaccctccttggtaagcatcttgggtatttatccacccggtttcataacgtgtagctatgtaaacacacccttcttttttatttggtaatagatagaatggaagcttcctaaggaaagtttttttccttgtttctcctaattcttttaatcatgtttatccttattcttttaatcatgttcatccaactgtacattcactcatgtatttgttctttcaacaagtatttactgcgtgccaactatataccaggcaagacctggaactacagtagcaaactgaacaatactatccacaccgttggggaatctttccatcgagccaaggagacacaaacaaagctaacaatgatgtggccagtgtaatgagggagccacacaaggctagggagctgggcatgcaggagagtggcctggactgtgcctggtctccatgagtcaaagactccgaattctcaggttgagaagtaatgttcattagctgggttatgttttcacgcatgcgggagatgagggaaagaccaatgcacctcttcagtttccccaagcacttaggtcttttagggacacacagctgtcaggtcataacaaattaccacgttagacaaccaaccagggttcccgcctctgggcacagcagcagtacctgaagtctaagagtcttgcagtgccctttagtatacataacatccctctatgaaaacaactttggggcttgtttatttgtttggttttgtaagataatcggattatactttttttcactttagaattttaaacaaattttgtttgtttgtttgtttgtttatttagacagagtctctctctgtcacccacgctgtaatgcagtggtgtgatctcagctcactgcaatctccacctcctgggttcaagcgattctcctgcctcagcctcctgaatagctgggattacaggcgcccgccaccatgcctggctaattttgtatttttagtagagacggggctttgccatgttggccaggctggtctcaaactcctgacctcaagtgatccacccaccttagcctcccaaagtgctgggcttacaggcgtgagccaccacacctggactaaaagaaatttttttaagagtagtcaagtgcagtagtgagaagaggggaaagagtagaagtttgatctgtaactgactgtgaacaatcagttgagctaattcactactaccttcagaccagccgagtcttctttttttagatacaaggtgtcctgtcagatcacccaggctggagtgcaatggtgtgatcatagctcactgcagcctcgacctcctgggttcaagggatcctcccctctcagcctcccaagtagctgggactacaggcttgtgtcactgcacccagcttcattttagcagatttttttttttttgagatggagtctttctctgttgcctaggctggagtgtggagtgcagtggtgaaatctcattgcagcctccacctcctgggttcaagggatcctcccctctcagcctcccaagtagctgggactttaatttaaaattttagcagatttttttttttttgagatggagtctttctctgttgcctaggctggagtgtggagtgcagtggtgaaatctcattgcagcctccacctcctgggttcaagcaattctcctgcctcagcctcctgagtagctggggttacaggcatgtgccaccacacccggctagtttttgtacttttagtagagacggggtttcacgatgttggccaggctggtctttaactcctgactgcaagggttctgctcgccttggcttcccagagtgtagagattacaggcgtaagccactgcgcctggcccattttagcaatttttaatgaaagttgtatataagataccttattcctgcatcttctcaattgcttcttttttatatttgcccttccttccctacttaggaagatttgtttggccttccattcaaggatcttttgtggtctttgtctagttttagcctggtgatggccatgtgctggtgacgtgcacacgacggtcctgcccttagcctcctcctgtgctcctgttcagtataggtggcacatttcttcctataaacctggactgctttgccaatttgctggcccgtatagtgtctttgtgcaacctcaacttcctcatcctttcagatgggcatggatggaactgtgcttgtagcagactccagaatgtgcttctgtctcagctctttggaacgagagaaagacataatcttcctacgaatgtgggaaggtgcattgaaatgacttttatgattcttgcctcagtcaaaagtcacaaagggactgcacttcctcttggtcactgccactctgctcatggccacaaaagggaagagtggattacacatttgtatacaaatcaccacactgagtgaagtggatgcttttgtgaatgttttcagttattcacttcatcagctctagtttcatgaccatataaaaattgcatcttagcaggtgtaaggggaaaggaaacaccccttctttcttctcttactttcttttgttttgttttgttttgtttttttgccagcggttaaggagacctgtagtttgagtcaagtgctagaattccagtatttagcaccaagaggtaaaacagacctagaaagctcaaaacttgcaaattgtaaagaaaaagacctgcagcagtttgtacctacattgtttaagctgagatttgaaggctgaaatgtagtgttagccacgagaagctgaggtgagagatgcccattcctggtcagggagcgagacccgtgaaggccttagggtacaggggatggaggatgtcagaactgagagcatccagcgggcaggagggagagcccaaggtgaggcgaagcttgacaacgcaggccccacctgggctcgctggctaaagttagggattccggggtctgctccaagcacggtggaaagcccctgaagagttttagcaggggactggctcaggcagctctgcataatcaataggccctagaaccttacttttatagtcagcaggcaatagcgctgctcaaagacttcagtaaacttctgcctacgtagcacattgcacaaagatgacactctgtaaatctgaaatacccaacggcaagtaattattaccccttgtttggccataaaagaattctaggacccaaaacatatgaacaggcagtttgggggttttatttttatttttgtttttgagacagggtctcactttgtcacccaggcttgagtgtagtggcatgatcatggctcactgcagcctcaaccccccaggctcaagcaatcctcctgcctcagcctgctgagtagctgggaccacaggcacatgccaccatacctggctaattttttaaaattttttgtagagacaggggctctcactatgttgcccaggctggtcttgaactcttggcctcaagtgatcctcctactcagcctcccacagtgctgggattacaggcatgagccactgcgtttggccatgaatgggcagttttttaacttccttttacttctgaagtaaagcgttgctctaggaagtaccactctcacctgttctagtagggataaggctacctggttttttattcctattgttatatggtaccaagaaatggtgttatattttagcctcagtttgccctcttgaaatggagactaaagtgttcccaggactcctgttacctcactagagcattaggtatcaaggacactgggttccaggtcaagtcagagaggcttcagccagcatcctgcctggaacagtgtttcaacctaagatctgcccttgggcctcacccagtttcttctggcccttctagggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggtgggtggacagcagtgtccagaggactgacaggcccatcactgtccatgggcaagtgcagaggtctggatctcacatcaggctgtggtgcctttgaaacttcaagagagagttcttggctcatccccatcacctgacctctccaacctctcaggtgggctggcccctgtcctcctttgagacccccaccacatgttccccgaaaggctcaccccagctctctgcattttgtcatgagagcccggtgaagcatttgccactgtggtagttgtgagtaaagagagatttaaaatgcaaagatttaaaacaaaaaatgtgaagacataagatacaagacacctgcgcattaggttttcctcatttgcacgtatcttgtttggagacccttgttcctgcttctaagatttctcatctttatcttttcccctaaatgggcctttccgttcagctataatcatcctcgcaacctcaagagaaagggaagtcttgttgctcttgccaggcctgcaacccactgggcctgctcactcccactttctccctgggtcccccgccataggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtgagtgagtctcagggggtcttcccaagggccagggtggtctgggggactagaagtaagttctgaaggagaaacctctctgcctaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattgtaagtgacactgaagggaacaggctgtgatgcctgccccaggggaggtcaagttcagggtcgctaccttcaagggccggggatggactaactcaaggcttctcagcttccatgtgatggggcctgtagctctgcatttctcacaggttctcaggtggtgcccattctaccagtccacatgccacacctcaaagcaagggaccagaggcatctgccaaatgtttggaaattaaaaacactctatagtgagcttttttttcttgagacagagtttcactcccatcacctaggctagagtgcagtggtgctatcttgcctcactgcaacctccgcctcccaggctcaagtgattcttccacctcagcctcccaagtagttgggactacaggcttgtgccaccacacctggctaatttttgtatttttagtagagatggggtttcctggcctcaagtgatccacctgcctcggcctcccaaagtgctgggattacaggcatgagtcactgcacctgagctatagcaagcttttcaagacatgagtcttcatcctcaaaaaaaaaaaagaaatgccattggtcagtttcagcctatgggcttcccttttcttttgggaagatgaagctgtcactcagattaatcacccaaataaccactgggggcccagtgactaaagtgataatctcacagccacctcttgttaagtaagagagtctgacatggaagacctttacctaaacacagtaagaagtagcagttatgaagactttataaagccttgccctacagtaatgtcacctaaaccttccccttttccagtatccatttaaagaaagccccgtctaagctgcccatgtggctgtggcttacgtgggcaagcagggaaagcaacagacagcaagctgaattcttagcaggaaactggcccttcgaagtgcccccttccccttcaaattgcccccttcccctctcttgttttctacaacacccaggtaatccctaattcctagagagactggagatgtctttccctttgaggggtattgaggtccccaaagttgatggatcattttccaagcccttcacatttgcctgctttgctctgctgcagtgcttctccaggcctggtgcgggcatcacctgggaacttgttagacatgcacactctgggcactggtggacacctgtagcctagctactcaggaggccaatgcaggaggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagaaagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcactattcttaaatttccatacagacaacacgccctctactgcctatagcctggatgggccagctccatgccccccaccccatccagccagtgccccacccaccccagcccccctcccctactgtgggtagagcagaacatcctggggttagacctcaccagcctcttcccctctagatcccctccattgccttggcgtacgagaaagctgaaagtgacatcatgaacaggaagcctcgccacaagaataaggacaggctggtgaaccagccgctcgctgtgtactcatacctgcacattggtacgatgagggcgcgtcttccccatcacacgagggcctgccccgagaattcactggagtggggggcacagccagaaagtgtggttttcctgtggggcctgggttggggagggagggggaaccgagagtagacaggatgaggcagtttcctgaggccatcatagaacctgtgtcctatctctcttgttctttcaggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatgggtgagtggcgggagccctgctgcagagtccacctgattctctccatgctcattgccctgcgcagaattacatagaacctccatgtccctgaacagcctgggaaagcttcaattaatagggctcagggcccccttgctgacacgtgtttggcctttgccaggtctcatggcacagcctcctgtcttgggctagatgacaagaggtccctttttttaccttagctttgccattggtatagaagagtgaccagcccagccacacccacagtgcggccaaataaatttacatctttcaggccgggtgcagtggctaatgcctataatcccagcactttgggaggctgaggagggagaatcacttgagcccaggagtttgagaccagcctggccaacacagtgagaccctgcctgtgttagaaataatagtaatgataattttttaaaaaattaacatttttctctactcagctggttcaagaaagaaaaatgtttctttccaaacactagaaggtggtccattctcagtccgggtgaggtgtggaaagaacatgaagctttagagaactgcattggaatttcctagaagttttcctttaggcctcaaggtctcttccttctctgcccattaacagacaaggtaccagagggaatacctagaatggacgggctacacggctttctttgttggcatcctagtccagcaaatagcagatctgatcatcaggaaaacccggaggaattccatcttccagcagggtctcttcaggtactgcctgtgcccggcctcctggggcagccctgggcctgccgtgcaaggatgatgatgatttgtttttcacaagacagagttctggccacacttgtaaccccagaggcattgatttttctggtggcatggtctgctgggtgtatgatcatgaagccacaagaatcccaagtctgtctgcttttgtgtgtcttgcagaaataaagtcatctgggtggggatcacctcacagatcatcattggtctgatcctctcctatggcctcggaagtgtcacagccttgagtttcaccatgcttaggtgagttcaccctcaacagcatggaggaaagagccagcctctgctttgagctgtcgcagcctaaataaacctgaggattcccagggttcttccccaagtctttcaaaagacgtcaaactgatcccatgctctgtgagcccaaagctttgatctgcattttccagaagtggaaatgggttttctagacctcaccaaccggccttcatcctcatccaacaggttgcttcaaaggcagacattgcttctagcagtcacagtgcaggttaaacaaggagctttccacctttattttgtgggacctcgtggatttgtcgttctttgcagtaaagcaagacaaatgaacgagaagccccattcccattgggcagggttgggctatccctgtggatgagtcagggttcactttccatccctttgcttccagggctcagtactggtttgtggctgtgccgcacgccatcctgatctgggtgtatgatgaggtgcggaagctcttcatcaggctctaccctggaagtgagtagcctatgattttagaggctctgtttacccacttcaacagactctccatttctgatgtacttttttctacctctacaggctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaatggtatagggaagaatgtgtttatgtgtatttgaaactccttgatgttaatagtcttgtgtaacccaggcatctactggggcctgccttaagctctagctaggattgctcagaactcctttccacaccctattaaaggccccatgacctccctaagatttctgcagatcccctgagaaggtatgttttcatggtctccttgctcgaaaaaggccaactcacccgagggtctgcaggagatggaagtggcggcaggtttacatcacagcagcacgcatgacctcagctttgactcgtttaactctgagacgtccttcttgaaggcccttgccacagtttccctggccacgccaccccatcccacctctggtcatctccccagccctttatgccccgtcgccctccacccctacatcagctcctccaaaactgagctcccagttcattttgcatatcctaactcaaaatgctcagctaatccaaggggactttctttaccaggattcaaccctagtagagagctgttatggtttcaatagtcatatttatttcttgtaaaacagttgccaggtgctctccagcaataacgttttgtcagtcatgtttcatgttttaacttaggtgtattcatgtgtgacacttccatgttgacaggcccggaaaggcctcatttttaactaaaagatgttttataaacccaggtttaattgtggtgttctaattggttcacatttttctagaatgaagagcatgggacaaaaaaataagatatgatttcctattttcttttcgttgctccttctggtcattttacttatctgtggaagatctggaaatgtaggatttttctttcaaactcttcctcatgaccccagggctccagccagggcctctgatgtgccctcgattcttggtcggacgcctgtgggagggcccgtctttctgcagcagcactcgagagaagggttctacagcctttccatcaactgcacacctcgcactaactcatttgacagaacgtgagaattatgtttggttaagctttcctcatctagtggcctgccccgtcacctctctccattacagtctcactcgggggcatctggggctgatggctctaggttggcatctcctggacaggaaaaggcagccttagagtcaccatgctcttggggtcacatgtaggagcaggaaagagggaaggagactatccttgtaactttatgtatatagattccagtgcatattgtgtgcagccatgtaagctaaaataatgttgctgtcctcaggagatttgtaatctgtgttcagccacaattatcattggactaatctatcagtagttccagtgaactgcaaacacttcccagagtggtttgggcagtgtggtcatggctttctcgttccagtctcgacaaggcagctaatgctttctagacttcagctaagaataacttgaccttacttaatctttcttgacaggctgcctgagtgctcatggctgcaatgcttggcagctcttggtcctgccaatgccagcaggacaaggccatcaatttagcacaaagctgcaaggtttaacttggggttggattagggttgaaaggagttaacttggaattagaagcctcttcatagcaggaactatgtatgaaataacgttcctatttgtgcttatttactcttgcaaaaagttgacactcaaatatttataaaattaacaaataactaacttaagaaatcccagaaaagacactagcattattgagtagctttattaagttgtagacagaaaaaggcaataaaatccatttcagagggtgtttttggagggactatttaattgaccctctgaagcctagatgtcttttattataggaaaaaaaaatgtcaatttaaatctaattgatgtggtagagtatctcagagacataaacatgaggctgaattcctagagtctttgctttttaaaacaatctaatttattctgattataaaattgcagctctaaatgagctattttcttaaatagaaaatttagaataaatgagattaaaaagtaaattaaaatcaccctgaatctcactatgtagtcatatacctaaatgaaagagtaatcatttctttggagtttttccacacatatatttatttttaggtaaaattaaataaagttttcaattctgccttttttatttaacatcaaaaacatggtgttaatgactgcacagtattgtagattgagagtgctttcgctaactatatctgcacggtgagatagctcattaatttcctactaggcatctttctcaaaaaggctgcatcttatcctcaatattgtaccacacatctccattttatagaagattcctcaaattggaatcaaggcattcagagcattcctaaggctctggccacacattgcctaatttatctttagataagctgtatcagtttacacccccaccagcaatagaaaaagaatatttatcttgcctatcattaagatgtgaatgctcagtcaaccaaagagctttccataattcgacaaagatgtaggaagtgctcctgcatggcttgagaacacagcccagaacaagatagagcatggagccagtacaccagtagaggggtgaaaggaaaatacaaattgtgataaggtcttgaaaaggcataatggggcttagataatcaggtggcaggattgagggcagtcagctaagtccttttaaatagggtagtcagaaaagtcctttttgttgttgttgttgagacgaagtctcacactctcgcccaggctggagtgcagtggcacaatctcagctcactgcaacctccgcctcctggattcaagtgattctccagcctcggcctccccagtagctgggactacaggcacccaccaccacgctgggctaatttttgtatttttagtagagatggggtttcaccatgttagccaggctgctcttgaactcctgacctcaggtgatccatctacctcggcctctcaaagtgctgagattataggcgtgagccaccatgcccggcctagcaaagtcctttttgaggagatgaatgcaaagaagcagacagaatgacaggaagagggaacagcatgagcaaaagctctgagaggtcagaggggcctagcaggaacacacagccagggaagaccttggaacggggaactggagggacaggcaagaatctcaccctagaggggttcagagaccaaatgaaggaggttgcatttaatttcaaaacaagctattaggcccagtgcagtggctcacacctttaatctcagcactttgggaggctgaggcaggagaatcacttgagaccaggagtttgagaccagcctgggcaacgtagggagaccccatctctacaaaaacgaataaacaagctattgaagacaattaataaaagaggtgacctgatccagttgacatgttcagatcactttggcttctgtgtagaggatgggaggcagaccaggctgtggtaactggtgtgtgtaccttcaatggaatacacagactcaatggaggagtttcttaaggggggttgcctctaggtgactcgagacataaatgttcaactcaggctcctagaaaggctcacaaccaccctgactgcccacatcacaatcaagatagagacaggagatgctcaagcaggtgtcatctcgccaggagtctagaacaagatatatgtctcaatgtacacggctgcactccttaagagcctggacaggtgcatctgactctacaaagatcatgagttctccacatttgttcattctgctatcatcattccactggtggcatctaatgtctcttaaaaagacagtggctggctgggcgtggtgactcacgcctgtaatcccaacactgggaggccgaggcggtcggatcacaaggtcaggagatcgagaccatcccagctaacacaatgataccctgtaactactaaaaatacaaaaaattagccgggcgcggtggcggacacctgtagtcccagctactcaggaggctgaggcaggagaatggcatgaacccaggaggcggaggttgcagtgagccgagatcacgccactgcactccagcctgggtgaaagagcaagactccatctgaaaaaaaaaaaaaaaaaaaaaaaagacagcggcaatcactgatatttgttaagtatctattatgttctgggttcctaacagcatgatcttattaacgctcacaacggccccgtcagctgtggcatcagccgtgctttacactcaggaagttaagcctagaggcccagtgacttcctggcactgtgacctctcctgaccactaagaggctccactgtagaatctggcaagtggtttagggagagtttgcccttcgatggaatatagatgcctctagagcatagcctgcaggtgttgagttctgtcttacagctctgcaggttactgataactgagagcaacagaaagtatttctatagatatgcaaatgaatcctacccagtgggtgaagatctttcctccttggaaaagccagttttgctccctttgcacaatcagccaacattcctgattccagataaaagcgtgcctctttgctcctctcagtagattttaacaactgcctagtttcctatttaagtggtgagctttaaaaaaaaatctttaatatgtgttcactgttatatctgtatgaaaaaattatccttacaccatgaacagaggaagaagaacacaattccctcctcatttagggtccttctcagcccctccgtggagctaggcacccagcccgtccgagatcctgaacccccgcacgctccagggccattctgctattgggcagggatgccgtttttttctgcttcagaccagttctctcagcaagctccttcttccccgtccccattcctactttcccaccctcccctctgacataccagaaccaagcttgggggattttatcttcttggtccagaggttctaagataaagttaactggaaatttaaggtaaaagcctgattaattttaaagggatagaagctgccctcctcagacttgctgtgcaggtagatagagattcggtggagtgaagcacttcaatgcaagagtttatttgtagtttgggggatttctttttttctaatttttttttttttttttacattttctatttacacaaagggatttcttccactccacccgcacccgccgcctctgctttcaatcttttttcttttcttttcttttctttttttttttttttgagacagggtctcactcagtcatccaggctggggtgctagagtgagtgcaatggtgtgatctcagctgcaacctctgcctcccgggctcaagcctcagcctcttgagtagctgggactacaggtgcactccatcacgcccagctaatttttgtattttttgtaaaaaagggggtttggctatactgcccaggctggtcttgaacccctgggctcaagtgatccacccaccttggcctcccaaagtgctgggactacaggtgtgaaccaccacacccaaccactttcgttgtttcaaatttagcacctgctaggtacacagcacagtgcagaacaatgctgtgctggtctgagaggacaaaatgacgcaatagggaagaccaggcatgtttgcaaataaactgtcaatcggggcaggatttggccgaggccttgagaggtatacagtgctgtgggtttccagggagaccatctttggtgggcaacagtggagggtgccaggaggcaaggcatccaactcagccttgaggagtagggttccaattgcagaggtgaagcagaggaaagggcaggggccaaagatgtgcccaggttggtcacagccatgtccctgtgagccagctccctccaggacaaagtcaatgtggtgcagagaccccatgacctgggtctagcattccacttggtattcctaggggggctgcagtatccattgaccaaatccctacagacagaaataagattgcctgtgggagaagaactctaatcagcccagcaagggctacattagagatctgcagaaagccaccttacacaggagccaggatgctaaaggctgtccatcagaaaggggcttatgtagccatagaaaaagatgtccttcccagcaacacggatgcaggtgaaactattaccttaagcaaattaatgcaaaaacagaaaatcaaatactgcatgctctcacaagtagcagctaaacactgggtacccacgaacacaaagatgagagcaacagacactggagactccaaaaggggggtggagggagggaggaagggaggcaggtattgaacaactacctactgagcagtatgtttaccccttgggggacaggatcattagaaacccaaacttcagcaccacaaaatagatccaagtaacaaacctgcacatctgaacctaaaataaaaataaaaaataaatttaaaaaaagaagaaaagggcccatctgtagcagagaccaagaaaagggtcaggccctgaggcccgttggtgtgtccccaaacccttggcacgggaggggcctggtcaggctgaggcatgaggatggcatcccaggcaggcctgggcttaatttgggaaccgggtgtcaggacgcaaagccacatctgctgactcttaactccgcactggcctgccaaccttctgacttgtgacccaacccggggaagaggccggctgggggatgtgaagacccctagccctgggcaatgtcaccgagactgtatgaatgcacctagtcgtggtggaatcagcctctgtgagccatcaacgccccggaggccacggccccggcagaccccggcatgggaaggcagggctggtgcgggcctgcagcgcggctgtgagggcacgagggcgcagggggtgagtcaggaccacgttcccgggcagcggaggacacaaagcgccagctcctggggggcttgtgaggattgaacaagcgtggacgcgttgagtgccttggaagagtcccggggccccccaagaggctcggaaggtgttcgcagcgtcctcacattggcgctccccgccgcatcgcgcgcctctgaccctgcacgcgggcttggagcctgcccctaggacctcagcagcctctgcaacggcctccgcatgctgcttgcttgctgggaatgcttctgccaacgtcctcagttcttcccccaccttcccagacctgcccaccctactaacaccccggtaccctccccccacactccctgccccctccaccttcgcttttcagcacaattttctcagcctctgacaccccatattttcacggctttcttattgccacctcccgacctacaagccctggacgctagctccaggaggatgggacctcgcctcctggagtccccactggagccacaggagtgcctggcactcaggatcgctcagtgaatgtttgatgaaggatcctgggggagtggaacagattgtcaacaagggaacgagtcaagaaaagaggcttagaaccgtggaaagacctgcactcagaaggcaggaggagccccggggtgatggcccgtgcctgtaatcccagcaatttgggaggccaaggcgggaggattgcatgagctcaggagtttgagatggactctggcaacatcgcgagattccatctctacaaaaaatttaaaaattagctgagtgtggtggcccacgcctgtactcccagctacctgggagactgaggcagagggattgcttgagcccaggagttcaaggaggcagtgagctatgattgtgccactgtactccagcctgagtgacagagcaagactctgtctacaaaataagaaaagaggaagaagaagcagaaggaggaggagggggaggaggaggaggaaaagaaaaagaaagaaagaagaaagaaagaaagaaagaaagaaagaaagaaagaaagaaagaaagaaagaaagaaagaaaacagatgtattcaactgctagacttagggatagtgtcctctagttcttttatattcttcatggaactgagtctagttttagacaaataaaaagctctcaatactcatccaaaaaacaaattagcaagcaagctgagctcaggctgggggcgggttatgtccaacgggtacattagtaaaaggtcactaatggccattatagtttgtagtttgagctcagagagaagtgatctctgtcccctgcattctcaaacttcattggcaaagtagggtccccagctgcacctgctcccctgtccttgggatctgacttctttcttcactgtggctactctcactaggtccagcggcccttcttcagtcctcgtggtgcttggcctctcagcagcattttacgccatgtcctagaaattcctctctctatggtttcccaggttctgcaccctcactgggtaggcagagagtgggccatgttgatatgacattgccaaacacctgtgacacttcactggaagtcagagtagcatcaggaaaagctagccctggagtgagaccacttgggttttgtcagagccaccaaccaagactaccaggaacacacctgtggtcagagttaggtttaattaacttgtgcttcaatggagagagtgcaccaagaaaaccatggggttctgggtaagatggcattgtgagggacgtatgataggatttggtttgtgctgggagatcctgaggagggtctcaggaagcaagagccagggatggattgggtgccattgggaagtgagggcaaacttgggggtcgggcgaaggaggacagagctgtcatgttttctcaggggaaacttgcctcctctaaccaccacccattgaacctgcttctacaaaggcaggtctagcaaattgctttaatcttcagacactaaaacccaatgctggggctatcttaaggatggctgcatcccagtatgtgtcctgtttgtctctaaaaagctgtattttaccaccaaaaatggaagatttagggcaacaggacaaatttgtgtcatctttcccttgtgattagactagagtctccagaagctagcagtcattccatttatattatacattagttcatctagctccttcataagcagtaattggccttttcacatattgcattattagagagaaaccattgtagccactctgtagaaacagaatagactccacccaaaatttggttcagatgccaagactgttgatgccacacacacacaccaagaaggtgttaaaaggtttactactcacataatgaaactttctcccaaggtggttcccaagcaactccaaaaatggcttggccaagcgcggtggctcacgcctgtaatcccagcactttgggaggctgaggtgggtggatcacgaggtcaggagattgagaccatcctggctaacacagtgaaaccctgtctctactaaaaaaatacaaaaaaattagccaggtgtggtggtgggtgcctgtagtcccagctacccgggaggctgaggcaggagaatggtgtgaacccgggaggtggagcttgcagtgagccaagatcttgccactgcactccagcctgggtgacagagcaagactccatctaaaaaaatggcttgagagagcagggagagaagactggcatgcagtttttaaagaggtgtctgaaagagagaacatccaggccttctgatcagcttgccaagatgtggggcaattcacaggtgaggagaatgaatctcagaaagggaaagaaaggagtgatgcttaaaagctattagcagcagacatcaaaaaaatggagtcaggctgggcatggtggctctcacctgtaatcctagcactttgggaggctgaggcaggtagatcactggaggccaggagttcgagaccagcctggacaacatagtgaaaccccatctctaataaaaatagcaaaaaattagcccggcctagtggcatgcgtgtgtaatcccagctactcaggtggctaaggcacaagaattgcttgaacttgagaggcggaagttgcagtaagccgagatcacgccactgcactccagcctaggcaatggagtcggactctgtctaaaaaaagaaaaaaaaaaaattgggtcagactctattacacagggcatgtctgaattcagtctgctcagtgggagaagagaacaagtgtaaagaaactatggtacaggttacagagcccctgtggcatgcccagaatcatgctaggcactcactgcagggccttccatggtgcttattatttgccagacactcttcaaagcactttgatacaggttaactcattgaattctcataataaccttaagaggtgggtactatacagtcagccctccgaatccatgcattaaaccaactggggattgaaagtatttggaaaaaaatatggatggccggtggcagtggctcatgcctgtaatcccagcactttgggatgcccagacgggcggatcacttgaggtcaggagtttgagaccagcctagccaacatggtgaaaccctgtctctactaaaactcaaaaattagctgggcatgctggcaggcacctataatgccagctacttgggaggctgaggcaggagaatcacttgaactcaggaggcggaggctatggtgagccgagataatgccgctgcactccagcctgcgacagagtgagactccatctcaggaaaaaaaaaaaggatggtttgcttctgtactgaatatatagactatttttccttgtcattattgcttaaacaatacagtacaacaacaatttacatagcatttacattgtatgagttatgagtaatctagaggttatttaacatatatgggaggatgtgtgtaggttatatacaaatacaccattttacatcagagacttaagcatcagtggattttggtatccaaggggaatactagaaccaattccccacgaatactgagggacaactatattatcaacctgtcttgcagattagaaaactgcaatgcagagaggctaagttgcccaggcatgcaaaattagctttaagcagcaaagtcaggaatcaagcctgatcagcctgactccaaagtctgtgcttttagtcattgtgtgacaccatttctcataaacagcagcttaactaatgcctgggaaatccaaaaatatttagttgagtctcttctacttgaagagctcgcattccccaagaatactttccatagtgaaagtattgcattattatattgtattatattaatacagctatatattaacataaaaaataaaacctcaaaagcatttgaatggtcttacacaattttcaaaatttcgtttagttttacagcatcactggaaattaaatgaggtggcaggtttatgactacaactccatttgtaaaatgcaggaaaaccaaggctccaagcagtcagccctggatccctccatggcccctctttgcttcatctgcaagctctggcgggaagtagtggttccacccaagagcagagctggtgaaattgtggcttgatggcagcccgcttcccgtggctccctgtccactgtggatgctgctgcagcctggcacgtgcttcgggacgcagagtccagggagcaggctgccactgtcaccgtggctctggtcatcattgccagtgtgtgccacctgccacggccgcagactctgtccacacattagtagctctgggaacatgggaggtcaaatgtcaattaagagcaacacgcatacttcacactcgttcgcaacagatgtttgcaaagccctttcaagttgatcctcataaccaaccttagaaatgatctgggcagttcacaggggaagagaatgagttcctgagagaacaatttgcctaaagtcgctcagatagtcagtgactgactcacgcctacctgcctcccttcatgactccagtgcacacctcacttaaagtctttaaaggtggagagactaaaccagaggctgagcaagctgggaatcaggagctcctgttcttgttcctgtgttcaccagatccctccgtggggcaggtgctggtgggcaccattatcatccccatcctgggcaggttgtccaggtgggcaccattatcatccccattttgcagatgaggaaacagaggctcagagaggacacaacttgccccaaggtcacatagctcataggtgtccatatagtccagtttgctggacctgagccttcctactacactgccccgccctgtggtggaggcccatttcccttcttctcctcctcctgaacaagatcctgggtaggagagtctcccagctataatagctctttgtcaaaagacagaatttgaatgaatttgaagatcttaattggctttgtgattctagaatcaggcaacgctccattctgtaaaataggataagtgttccaataaactgagcagaaggagttggttttatagacaaaaaagggtagaagaaagcagaaacaaacaagaaaaggagtattgatcctttcaaagttactttccttgtaaggtggaaacaggaaaacagaacaatagaaaggtaactgattagttaacatcaagttatttcaggttacttttttctttttttttattgagacagagtcttgctctgttgcccaggctggagtgcagtggcacaatctcggcttcacagcagcctccacctcctgggttcaagcaattctcctgcctcagcctcccgagtggctgggactacagatgcccgccaccatgccagctaatttttgtatttttagtagagacggggtttcaccatgttggccaggctggtcttgaactcctgacctcaggtgatccacccacctcggcctcccaaaaggctgggattacaggcgtgagccactatgcctggcctatttcaggttactttttgttgtgcagattaaaggcagagggaactttattatcatgttgactgaaactggcctatttggggatattatctctatctcctgatttctccaagagtcagatgatttggtttggtgacatggaactttagtatgagtgactccatcttggcttctggtctggtgagctggagcccagtgcaggatcttagtccaaaataatgacctcataatttttataacatccttatcctggagctaaaaaaacaaaactgcagctcttgtattcgttgctaccaactgcttcttatagcatgaaagacagaaaaagcagttggattacatcattcccctgtgtgataaaggacaatgtttcatcacacctgccacgctctgccagccctgcctttgcccaccttcccagcatcactgggtatcactctcttccttatccaccagcttccagacccaccaccaactggaagagggtcaatattacattaaaggggagcacatagggtgacatcggatggtggccgtctttaggaacatgcaattagcctcaaaaacaagactaacccaggtgaaacagttaaagaccagtaaaagagcatgcataattgtgtgccaggatggagggtgctgataaggacagggatctgaagagcaggtggtgctggtgagtggggaagtctgaaggaggcactggggatttggaagcagcttaaggtgtcagtacagtggtgaacttcgacaattaaagtactgtttcactaaaacaggtaggctcatgtatgtggaataagtattttcagaaatacttgtcaattcagatgggagttttacttgcctgtatgatgaaagaagaggaagtggggagaaataagaagagaagctctgagaggggaaagaaggctcagaattgcattccccttgtgagcgtgctgtgtctcagggtgcccactccactgggctgccattcttttcttctttttccttttctttttttttgagatggagtctctgtcgccaggctgaagtacagtggcacgatctcggctcactgaaacctccacctcctgggttgaagcaattctcctgcctcagcctccccagtagctgggattacaggcacgtgccaccacactcggctaattttaaaaatatttttagtagagacggggtttcaccatgtcagccaggatgatctcgatctcttgacctcatgatctggctgccattcttccacaatctcaaattccccttaccccattaggcttcaacaggccctcatttgtttcttcatcttctctctgaagccattgttgaaatggatccatctgcattggaatcgtaaccagggttggtgaactgcatggaatgcacatccaactagagaatgagagagtaggaaggcatgcaggacagaaagtggtagccaaaaactgctgtgatgagcccatgagagctgagacgggactttgcttcgggatctattcaacttcttattctattatgacgctggaaggagggatggagagtcttcccaccacagaggaggccagatcagagtttggccatgcaggaggagcagctgcaggtgtgtggacccccacaactccaccccagccaggtgcctgtggtagctcccaggaaacgccctggggccggcacccagcagccagtggcgggcaccatcagtgactaacatggatccattctgtggccatctaaaacaacaggctgcattttgctcttaaaagtcagcccctcccagctactggggaggctgaagcaggaggatcacttgaacccaggagctggaggccagcctgggcaacatagggagatttagactcaaaaaaaaaagaaaaaaagaaagaaaagtcgatcccaaacttgcttcccttggccagcctcacaatagagtagacgcagggcatgggctaggactggtgcccttctgaggtttcctaagcataataacttgcctcagtgcaaacaaacgcaatccctggaaacatagatattgtttcacagtgtctacagcttcatgtttttggaaggagaaaccctgatgctcgcagcagtgaatgtatgccagggaatggaaggaactagagaaatgcacgtgaaacaccgaggagtcagaagatgcagcctcaactctgtaaggcaaggcaagctctctctcaatgcaggatgcagtccaggcacatccagcaccaggacagctgtaaaaggacactggcctgggctccatctccaacctcctgaatcagaacctccagggctggaacatctgcagcctctccaagaaagagatttttaagctggaggtgtctgagctctctacctgtcgcccacatcctgcttggtcaggagagcagtcctccaccctgacaggcagatggagaaggcctctgatgaatggatggaggaagggtcagtgagggctagtgttggagtcctgaaggagtgagggagaggacagtgggtgggtcctaatgctctgccccccacgtagggaggctcacagggcacatgtcctcaggctctgcaggtcacctacccaacttttagttataatgtcccagagcttaatatggggctatttctcaagaaaaaatagtagcccctgtcttgtcccctaactcctcatagcagcaagtttgaagtttgctgatctacaaaaggtcctcaaatctggcctgaagcagcaatagtatctctccatttatccaaaaattcatgtttgtgtagtccttctctgttgtaattcccaaagcaagagtttttaagtgcaggagcatgtctgaaaatcaggacccccagggctcttgctcaatcccaagaaggttagagtggttcttagcttcagctgtcccatcctaaacgaggaggtgggattctggaatttctaaaagtcattcctactccactgccctataatttctaagaaaaaagccagccacttcgtcatagagttgggtattccacctcctctgaaacatgtatggagaacagcttgaaccttttcactgctcacctctgcttttagtgactaaggatagaaaggtcagaggcaaagtggcaaaggacttgaaaactaccttcaaaaactaactgcaaaaaccaaactactaatatcgtttggtggctgggcgcggtggctcacgcctgcaatcccaccactgtgggaggccgaggcgggcgaattgcctgagctcaggagtttgaaaccagcctgtgcaacacggtgaaacctcgtctctaataaaatacaaaaaattagctgggcttggcagagtgcacctgtagtcccggatactcaggaggctgagacaggagaactgcttgaacctgggaggtggagtttgccgtgagccaagatcgcgccactgcactccagcctggcaacagagactttgtctcaaaaaaaaaaaaaaaaaaaaaatggtttggtgtgggtctggcgccctctggtgtgttttgagactgtgtcatgctggctggtgctaagttctccctgctgccatctgtggtctgacatgtgagcacatgctgtatatgctgagagtgctgtattataaattattattattattgttattattttgagacggagtttcgttcttgttgcccaggctggagtgcaatggcacgatcttggctcactgcaacctccacctcccgggttcaagcgattatcccttctcagcctcccgagtggctgggattacaggtgcccgccaccacacccgactaattttttgtatattttttttttagtatagatggtgtttcaccatgttggccaggtttgtctcaaactctagacctcaggtgatccactcgcctcggcctcccaaatgctgtgatcacaggcatgagccaccacacccagactataaattattttaattaccacctgatactttcagtaaatctagaagaaaaatggtaaatgcaaggttttattaaaacaaaaacaggctcaaagttaaaatatacttgagcctttattaaaaaccacaataaaatggccaggcgcggtggctcacgcctataatcccagcactttgggaggccgaggtggacggatcacaagatcaggagatcgagaccatcctggctaacatggtgaaaccccgtctctattaaaaatacaaaaaaattagccaggcatggtggcgggcgcctgtagtcccagctactctggaggctgaggcaggagaatggcgtgaacctgggaggcagaggtggcagtgagccgagattgcgccactgcactccagcctgggtgacagagcgagactccatctcaaaaaaaaaaaaaaaaaaaaacaacccaataaaatgccatcatagaatatctatgcttgtctgtctgtctgtctctctctctccctccatgttttgagatggcactacagcaatgtgtaaaaggtaaatcaaggttcatgaccctgtctgtatcaattagtgggctcttgagttttctattgcacccaacagcaccccactcctgcaaaaatactaacaacaacaaagctgaattttaaacaggaaaagaaggcaacaaagcttatggaagagaacaaatatggaagatatttatggaataaacatggaatggaatacaaaacaaattatggaaaataaatacaatgaatcagaaaggatttctcaaaccatacttgaaaatcgtaaatcttaatgaaaataccatagaaaaataaaacatctttcgacaataagagatataaacaaagttaaaaagcaagtcatagcctggaagagtatatttgcaatgggatctaaaataaataaataatagctacaaaactgtaagagacaacccaaaaggcaagtaataatacaaaagcctaaattaccaataaacatgaaaaagatgttaggttccttagtcattagagaaatgcaaactaaagccacaaggagctctcatagtgccttcaatgagttagcaaaaataagacaaaaaaaaaaaaacaaaaaaacagctgtcaagtgtttttctaagtattttcataaaagattcatatactgcaggtgggagtgaacagggaggctaaaaagcaaaaaagttttctatcttgtatacatttgagtgcagaaaaaacccagaaaactcccctgataatctaagcacacctgccctcgggtgggcttaggattcaatataatgatcttcaagtagtccaggaaaatacaagccaagaaattatagtagccctagactcacagtgccttggagcaccttaacaaaacaaaaacaaaatctggagaaatgtacccttaatacaggcctcacagtattcccacaagtcaaccctttcaaacatgagtttataatctaaaattacaaaatacattaaagagaaaattaattaactgaaatatatatttgaaaaaattattcagaatgcagcacagagagagaaagaaatggaaaatataaaacagaggttaacagaaacaaagtgtagagtgagaaggtccaatttactgcctaatagcagttctagaagaaaatgacaaggaagaggtaaaatttaaagagacaaatgactaacaatttcccagaccaataagacaagaatgctcaaatccaagaattataatcaatcccaagcagggtaaatgaatatctacaccttaatattataatgaatgtatataataccaaagaaaaataataacttacctatatggaaagacaatttgactgtaagaaaatttctcgatagcagtaatagaagtcagaaatcaataaaattatattttcaaatttagaaaaacaaaaaaaaacctgtcagcctagacttttatattactaaacaattactcgagaatgagggtgagataaaaatacatttttatccaattaaaaactgacatcattcaccaatagcataccctcagctaaaggcacttcttcagaatgtccttgaagaacaaaaattactgtagaaagaagatatgaaacacaaggaagaataaagaatcggccaacacgtgaataaatctagatttattaataaaactaggttatttattaaattggttggaaggtacatgggcacagatacttctttattcttttttgtgtggctaaaatatttgatagtatttttttaagtagcacagggaaaagagttctaggcagaagattctgaggctagaaagagcttgacctacttatacaactgaaagagagctagcatatctggaacagggtaaagagaagtggtacaaaatgagggtggaagggagtaggcaagagacatgaatagacactttccaaaagaagacatgcatgtggctaacaagtatatgaaaaaatgctcaacatcactaaccattagagaaatgcaaatcaaaaccacaatgagacaccatctcactccagacagaatgactattattaaatagtcaaaaaattgcagatgctgttgaggttctgggaaaaaagggaacacttgtgggaatgtaaattagttcaactactattattgggggaagctgcccccaatatttcaacgtaggttctttctattttccgtaagtgtcggccggctgagaaataaagagagacagtacaaagagaggaattttacagctgggccaccaggggtgacatcacctatcagtaggaccatgatgcctgcctgagtctcagaccagcaagtttttattaagggtttcaaaaggggagggggtgtaagaacagggagtaggtacaaagatcacatgcttcaaaaggcaaaaagcagaactgctagtaagggtctaacaaagatcacatgcttctgagggaacaggacaaagggcaaaagcagaactactgataagggtctatgttcagcagtgcacatattgtcttgataaacatcttaaataacagaaaacagggttcgagagcagagaaacagtgtgaccacaaatttaccagggcagagtttttccccaccctagtaagcctgagggtactgcaggagaccagggcatatctcagtccttatctcaactgcataagacagacattcccagagcagccatttatagacctcccgcgaggaatgcattcctttcccagggtgttaatattaatattccttgctaggaaaagaatttagcaatatctctcctatttgcacgtcagtttataggctctctgcaataagaaaaatatggctctttttacctgaccccgcaggcagtcagaccttatggttgtctttccttgttccctaaaaatcactgttattctgttctttctcaaggtgcactgatttcctattgttcaaacacacatgttttacaatcaatttgtacagttaacaaaattatcacagtggtcctgaggtgatgtacaaccttagtttacaaagataacaggattaagagattaaaataaagacaggcataagaaattatgaaagtattatttgggaactgataaatgtccatgaaatcttcacaatttatgatcctctgctgtggctccagccggtcctgccgtttggggtccatgacttcctgcaacacattatggaagacagtgtggcaattcctcaaagacccaaagacagaaataccattcaacccagcaatcccattgggtatctacccaaaggaatataaatcattctattatgagcacacatgcacatgtatgttcaatctagtactattcacaatagcaaagacatagaatcaacctaaatgcccatcaatgatagagtggataaagaaaatgcagtatatatacaccatggaatactatgcagccataaaaaaagaatgagatcgtgtcctttccagggacatggatggagctggaagccattatccttagcaaactaacataggaacagaaaaccaaataccgcatgttcttacttataagtgggagctaaatgatgagaacacatggacacatagaggggaacaacatacactcggacctagtggagggtggaggtgcattgagggagagggttaggcaaaatattatatgtattttgtataacagacccccatgacatacatttacctacgtaacaaacctgcacatgtacccctgaacttaaaataaaagtaaaacaaacaaacaaacaaaatgttcatcactaggaaaacagatgaacaaactgtagagcattcatgcaacagaagactcttcaaccacagaaaggaacaaactactgaagaacacaccatagacgaatctcctaaacttgctacatgagacaagctggacaccaaataatacatattgtgtgatttcaggcaaaatgaacctatggtgaaaaaagtcagaataaaaataacccctggggaaagaaaaatttgcctgggaaggaatatgagaaaattcctggggataatggaattattctattctttttttgagatggagtctcgctctgtagcccgggctggagtacagtggcatgatctcggctcactgcaagctctgcctcccgggttcacgccattctcctgcctcagcctcccgagtagctgggattacaggcgcccgcccccacgcccagctaatttttcgtatttttagtagagacgttgtttcatcatgttagccaggatggtctcgatctcctgacctcatgatccacccaccttggcctcccaaagtgctaggattacaggcgtgagcccccgcgcccagccaaaattattctattcttagtgcaatggcaaaatttcagctcactgcaacctctgtctcctgggttcaagcaattctcctgcctcagcctcctgagtagctgagattataggcacccgccactacaagtggccaatttttgtatttttagtagagacggaattttgccatgttggtcaggctggtctcgaactccggacttcaggtgatccacccactttggcctcccaaagtgctgaggttacaggcatgagccaccgtgccctgcctaattattctattcttaaaatgggtgaaggttatatgggtgtatttaattgtcaaaaatatacagttaatttttgtgcctatgaatatgtgtacatttgagctcattttttaaaaaaaagaactaaaagaaatgatgggatggaaaatgggttgaagtatagatgaaataaaaaaggcacatgaatagtagtttttgaggctgggtgacgggtctattatactattttgtctactttgtgtttaaaattttctataataaaacactggtctaaaaagacaagttatctacaatgttcttaaaattttggttatcttttcaggggagggcaagaaaaagtgattttcaggcatgatagaggctgattctattccttggtcacacaagtttatccactttgtaataacgcactgagctttacatgaatgctttgtgcatgcatttctgtatgcatgttacaatatcaataacaattttaaatattacatttaaacacaaaaatcctaacagcatctcagaacaatggcagcactgttgtttgttttaaaacaggatatgttcactcatggcattatcagatgacttttaatattttgagatatttattcatgtcctaacccttggtaagtggcatggtttttatttttcatgatgcactttttttcagcaaagtcctcccccaaccgtgctgctcaccaaggccctggcacctagcacagtgccctgggaaacttgtaaatctgggttagatttgggacaaaacaggaagtagaggtcagttccttccaagagaagtaaataggtaatgcaaggaagattgaaaggccgcaactcagcagcaaatgtttttacattcatttgagaaacacttgcaaagagtttaccaaaaaatgttggtttaaagcagcagttttgaggactggctgcacactatggaaagctgttgtttatttatttatttatttttaagatgaaatctggctctgtcaccatcacccaggctggagtgcagtgtcgtaatcatagctcactacatcctccaactcctgggctcaaagtatcctccacctcagccaccaaaagtgctgaaattagaggtgtgaaccaccacccctctccattcctggggagcttttaacaatactgatgtcctggtttcactccaggaattctgggttcattggtctgttgcaacttgggtttagggggatttttaaaagcccccatgtgatcctaatgtgcagccagaggtgagaactactggttcatggtgagaggtgcattagctgtgcctcatttccatgtgtgctgtagcaatttgccccatggccattgctgcatttggatttttggaaaaaagctttgctgtgttaaaaattagagaacaacttcaagatgtactcaactgtgtggttcagtggcagcaggaggaagtgtctcccagcagatctatctttatgtcacttgcgttctgagtaagaggttgtctctggcacagtagtttatgatgaaaatcataaacaggcgtgctgaggtgggtggatcacgaggtcaagagttcgagaccagcctggccaacctggtgaaaccccatctctactaagaatacaaaaattagctgggtgtggtggcatgtgcctataatgccagctactcaggaggctgaggcaggagaattgcttgaacctgggaggtagaggttgcagtgatccaagattgagccactacactccagcctgggcaacagagcaagactctgtctcagaaaaaaaaaaagaaaagacaatcataaatagtctacaaataccaaaaagagatcaaaagaatttgcacataatactttggccggctgcgatggctcatgcctgtgatcccagcactttgggaggccaagacgggctgatcatgaggtcaggagatcgagaccaccctggctaacatggtgaaaccccatctctactaaaaatacaaaaaaattagccaggcgtggtggtgggcacctgtagtcccagctactcatagctactcaggaggctgaggcaggagaatggcatgaacctgggaggcggaggttgcagtgagctgagatcgcgccactgccctccagcctgggcaacagagtgagactccatctcaaaaaaaaaaaaaggatttgcacacatgtggagtgcattatcatgctttcaaatttctcctatgatgaggaatgaaaaatataatattgggccttgatttcctaaatggccctccgccatttccccaaattattccaacttttcccaagacacttcagaaacattctctggagggaaatattgcaaatggtgaagagtactagatggatgagaatcccatgggattcttgcttaaactgcagaagagtcaccctccaggacttcaaaaatttacggaagctgcatgagtagtgtgggctatggaagtcatgggcgtcgacgtcaggccgacttggtcctgagtccctgtccagcctcttagttgctgtggggctttggacaagttccctgacttgaaacacttatataaacctcacctgcaagaaaatgcatagtgatactgattgcaaaaatggcatcaattcatcatccttccctgtatccagaccctttgcagtgtgcttgtacagatgttctcattaagaagcagactctgtttcccaaaccttggatctcagctggccttatttgctgtggccaatagaagactgcaaacataacagtgtgccagcttggggcttaggctcaaaagttcttgaatgctttgtttttctttcagaattctaccatttccataagagcaagtctgtgctagcctgttggaggacgagaaaccatgagaagcaaagtgccacagttgacagccaactcacccccagaagcagagatgcctagtcaaccaaaagttaagcacacatgtccaaaggggcccagctgggtccagaagaatggcccagctgagcccagcccaaatggctgaacagctcaatcatgagtgaataagttttgggtgatttgttatgcagcaatagctaaataatacatgcacccagtgcagataggatgctaggattcaaggacaggttgattacaagttacctgcaaacagaagacaccctacagttgctgattttcttttcctcttatttaaagttgggcctcttgcttgatggcatcgagttacacagaaatgcatgtagacatgtctgcatgtaattggtgcttaaactacgcagtcctccacagcatgtgaggaaacaaatgtacacagcctgaccgttagggtcaaggccaaatagcaaagtaagtgtgcctttaatctattccctccatatctaaacttcgtaggtcaaggctgtggacagatctgaagacactgggtttcctccttttgggggccccatcatcctttgttcattttctgatctctggaaagacgatgggcagcaggtgggcagcagggaaacctgtggacactttgttcttgtagcccctgccctctagaggcaccatctctcactcttgggcctgaagagagctgttgggagggaggaggtgtcccctaacttctggcagaaaagagtgtttcagacccgtcacctccctcagctcagggcagtcagagtcctccgagctgcgcttcagtgtggtggccactggccacgtggggctgctgggcacctggaataagctgctttgcactgacgtgtgctggaaacttaaaaatccagagagttgccaaaattagtaccaaaacttatacactttattaacaattatatactggtctcatattaaaatgatcatattttggctatattgggtcaaataaattattacaatcaatttcacctgtttctttaatatgtggctattagaaaatttaaaatacacatatggttcacattttatttcttagaagactgtctcctttttgaaatctcaggctgcctgctcaaaggaccaggggccaggaagatcataaaaatccaaaattctaaaataattgtcattatgttgtttctacttgtgaattttatatatatataaaatatatatattatatataaaatatatatattatatataaaatatatatattatatataatatatatattatatataatatatatataatatatataatatatatataatatataatatatatattatatatatagtatatatataaaatatttataaaatatatataaatatatataatatatatataaaatatatttataaaatatatatataatatatataaaatatatatataaaatatatataatatatataatatatataaaatatatctatataaaatatatatatataatgtatctatataaaatatatatataatatatctatataaaaatatatataatgtatctatataaaatatatatataatgtatatatataaaatatatacatataaaatgtatatatataaaatatatatatataacttataaatgaatataatcttatacacaaggttaaatgtaaatgtccccagggcagggccaggcccagtgctgggagaaagccctgtctgaaaaacctgctgccaggggcctgtggttcttgcttcatccaacccagtatctgatggcatctcctgtcttcggtctcaccatggcttgcatgtgtggggccttctctccatttctcccaggccccttctgttctccctgttccctccatcatgtctcagactctggccttgggactagaagccccttcctagacctacctcagttgtcatttccccaaacctttcgcacaggttgaggactggactgcggtcctctctgccctgggaggcagtgggagctcagcaccacccacatctcctgctcccctgactccctcaggagagatttgtggtcttagcttgtcatcatcctctctccccagcttcagtgagcaggccagggctgccttgggaatcaggatggcgacagtgttaggggggctctctgaccacgtccgcatcacagaggagttaacttgttgtgacagacaggtactagggcagctctgctgatgacctaaccaaggccaaggtttgggcagagcaacaaatgttggcagcctccacctaccaggctttgtgctgctgtgcttctgagtcagtggggcaggttagataggaggagattggggctggctgacttccccctagcaaagattgggggaaagagttgaagtaggccgtgcgcggtggctcaagcctgtaatcccagcactttgggaggccaaggcgggcggatcacgaggtcaggagatcgagaccatcctggctaacacggtgaaaccccgtctctactaaaaatacaaaaaattagccgggcgtggtggcgggcacctatagtcccagctacttggcaggctgaggcaggagaatggtgtgaacctggaaggcagagcttgcagtgagccgagatggcaccactgcactccagcctgggcgacagagtgagactctgtctcaaaaaaaaaaaaagagttgaagcaacttgcccaaggtcacaccatgaccaagttgcttaggggagcacttggatttccacctcatggccggcaagccaaagctgcctggtctggcccggaggaaacggggactggtgtgttgttctgaatctcatgctgagaatgaggggctgtgcagagtctgttggagaatttctgggacagcatcagtgaagctccttctcaactgagggcctctatctggggtgaactgggtcaggggaaggcacagctgttcatttgggggaaactgggagcatactagtgggtaggacatcagcctcatgtccctgggaagctggtgtagatggctggggcttccattacagcagtcctggatctattgaaggaagccctaattaagatcctcagcatgatcccgcctgagcacctaaagtgaggctcctgatcccaggacccggctctataaaactcttcagtccgctcaaggatgagacgatgaaagccactgggggtggggcaagggtcagttaccttcttaggaataaagcagctggtaggggttaagagaacaggcaagcatttctgagttcacaggggagtgtccagttccttctgcctaggggaaggctccctagagctgaggcccagaggggaagagaagggggctggcagatgtggggggcttcagggagctccccaacaggatgctgaagctctctgggatgagatctggggagagtaactagaggagctctaggtgatcctctggccctgaagacctgcctctggcctgggtgggacagggaggaggcaaacagaggtgcccacctcttttggggcttccacaggctgcctgcttgcctcatcctcttttcttgaagctctgggttgctgtgatgggatggagtgatgtgccttttggggccctacttcctgctggggcttcacctgctgaggcctgggctggggtgcggcctggccctggcatagtctcccaagtgggtccatgccaagctggggaggcacacaggccacctggggtggcgtaagtgtcttttctcgctcctgtctgttgtgtgggctttctgtgctcccaggccaggacaagggtgtgcttcatctcttcaccctaatttctttcattaaggctggggaggcacgtgttcaagctgcatgtgtgcagagtgctacgagggcagccctggcctgttctccagagaggatctcctttttccctttccttaaagctcagatcctcagaggtggccctggaacatgagaggagggggtactggcccaaggcgtagaggtttctgcaggtcctatgactgggctagatctgcccctgggcaggtcctgaggcctggaggaggaagggggttctgctgacatttgggtgctgcagcctggtcccagggagcaggaccgcctggcctgtgctcagtgggggtggcactcaaaggcatgggcttggccatcggacatatctgaatgtttcttgacctggcttggctgcccctcgcctctgtgaccttgggcagctgcttccctgccctgtggagcccatttccttgggtgagatggggtggtcgagccgatttagggaccagctatgggctgggcctagtgtgatattgactgtagggtaaccagaatgggggcggttgtcaatactcttctgggtcactgtctggccgtcctgtgccgcttctctctctgtaaggtgagggtgtgtttggggaggggttgggagaggggttctgcctaggcctggcccttcttccctatgatcgttgtgtgaggtccagaaccctgcatggagctatgtagaaacacaggttctgcctgggtccctgggcctgaaggggcggggacggagggagagcctggctcctctcaccctggtgagggtggaagcggagccgtcctgactgggccctgaccacatggcagaggccctggggagacaccctggcgagctgggcatgctccttccccccagccacacagccctcagcctcttgctgccagctctgttccccctggagagacttgattccatcctggcagggcaggggctgtgaggatggaaaggtagagcctgccagcttcttagtggagttcagaggactggggcacgggggcagttgtcctctgggagacggggtgggggtgtctatctccctccctcccaccagaatgagtgactcacgggaaggaggtgcctgctgggccacctacagggggcagcaggagccagaggccccagccagccatttagcccaggaagcagacaaggcactcagtgtctgagactggtggactggggtagcgcctcgtggccttggactgggtctgcaccagctgttgccagcagctggccaaagcagctgcccgtccccctggggtgggagctgaggagaggacccccttgctgggcctgcccctgtcagccaatctcctaggccctcgatctttgcaggtccatgtaccccaaatgctgggctctcctaccttccagcatccttaccagcagcagccccctttctgaggctataggcaggtgggcctgagtgcagggagcaggtccccctggtatcctggagccactgaggcctcctggcccacagctgtcctttgggccaacctagagttagatgcaagtcacggggagtgcacccttcctggggccaccccagcaggcctggtcccactgaaacacaaagtcagctcgagctccagcccggggaccaacgactgcattagggcaagggtagtggcagagactggaatgatggacacaggcagtgccaggcctgggccagaaagctggctacttcgctaccatggccatcctgagactccagagtccaggagagggtggcgccaggtgggcagtgggagcctcgtgaaccagttggctaccctcttgctggggaggtcacttggctttcatccagagataggaagacgttcagggttctttggaggaagaaggaggggcaggacaggatgtctcggtgataggaggtccctgggggaccagccatattactttgaaatcttacccatgggggtggagggttccctgggctggggaggaagaacgggggctacctttccttgtcttccctcccctcccccatgcctcccatcccagacatgccaaggacaggctgcccatctaggtccagatctctggctcccggcttctgggatctcagctcaaaactgctgctgcacattgggcggaagcccttcctgcttctcccctcactccggtcttggcagccagcatagcttttctcagggacccagtgggggaggttcctcccacccgccctccctcttgctgcttcttgaaagctgatccacttctgcccctcctgctcctgtctgctctgttgtaagagtcaggcaggttttcacaacgtgatggggcttgtcacttgctaggggattggggttgccatgacattttctccagcttgggctttgacatctagtactactgtaaggattttggcagggatgtggtggcctccatagcacccaccacccacctgaatggcacgcacacatacaaggtggtgcatctggaggggctgtgcacgctgggcacagtgatggtgaataactgtggctaccaggtcatggcccagtccatcatcttcccggcatcttggagtggaaccagaagcagagcttcatctatggttccactgactttggcaagagggtggcgtcacagccacagtacctggagctgctgggtcactcaagttagacctcaagattctgaggcactgtgtattcaattattgagatgaggaggtagagctctgcttcttggtgggtgtcactggcaaaacaggcaccagtataccctcctcctgctgtgcatcttcccctgaccacagcttcctgcccgtgcccagtacgcagatgctgtgccagcttcccccatgcccaccggcaggggctctgctgcctgcaccaggagcaagtgagtggcttggtagagcactggtgaggagcagccctgggaggctatagctagagcaggctacatcctgccagagagcatggccacactgggttgtcctggggctggatccttgaagagagaagctttggaaagcgaagaagccacactcactagagcccccttcccatctcccacccaccctgtggtcagtctcccaaatgcagagatctacgttggttgcaaactagagagcagccaaaccagtgacccagctgaggcagtactgttcccttaaggagcacgtggaaatctactgggtggctgtgaatatcaccatgtcaagggtgggcaggtgggacactgggtgttggtgccactggtgtttcatgcttaggagttggccatgtcaaatgtcccaagccagaaataactctttctcaaatgccagtggcattcctgtcactgttgagagccccagcctgaatggggagcccctctctgcccccttcatactatagctgtcttcttcctggctgggtagatgttgggttttgctgtgacctgatgctgttgggtgtgtgcacgcccatgcaagtgcacactgggcaggatatgtccccatgcctgcaggttgtgcagccccacattcctcagccacagcaggccaggacgctgccaggccagcaaagcttccgaatccccctctaccatctcctgctccaccctgtctggtgtactccaagtgcctcctcttcatgaagctgctgccctgcagcctgatgcagcagaaagccagcaggctggagcaccctacctccctggaaaatagcactcttccttccttggagtcttagcttgaagaccctctgggacacaaggcaggaattgagaagggcagaagtgctagcagccgggccaaggggaaggggctggctgagagcattgctgcagaggacagcacaggtggggttgctctggatgccaggggagagcacccagcctgtcctggcagctggtcactgtcagtcatcgctcatgacccagcctctgagagaggcagggagatgcctccacagggagctgtggggtgagattcacgcagccactcctccaatggtggaggtgggccacctcccaatgtgccctgtccccacagtagaccctcgacaccaggaagtgatcctcaacgtgtgcaagggagtcagctccatcagcagcctggccttccacagaaggccctccaacctggacatcttatcaggcaactggtgggggctggttggcactggagcccggtggggtgagacagagcctctttgggggagcatctttggccctcggtgctggtgtgcctgtccagccatgtgagtgtggcgcctgccagccccagacagcatctgtcttaccaccccctgcctcccttctgcctcattcaagcttctctgctcctcttccaggcaggggttcacttccctgagtcctgccaagatgacgttttggaaccaggaacagctgctgaaagatgtggctgcctttttgctctcctgccaaacctctggcttggtgagggaggggtcatggggtgcgtgggggcttgcaagttttatcaccctagttgaaaactttttttcatctcctagtgtaagataaaaacttggaaagatgggtctcttgagatgttgttaatggggaccaagggtggcctagggagcacgtagggagcagaactcctgcatgctcttctggagaggtgtggtttttggaacttttctagagtggggggaaaaaataagatctccatggtcagtgaaagggcagttcttggagtcagctagtggttctgattccccttttcccacagcagtggactcgggtgggtgggctgagagggcttcctgctctaggaagcagaacagggccctctcccctgcaaagcgccagggaggccccctctagtccacaggcgggtgctcctgactttcccagcttcggcttcggggactcatatcttactctctctttttctctctctccacctccctcctctctctcctctctggctctgccctgtggctgaagggctcgcaggataaactcaagggcaaccctggggtgcaccctgccaccttctcggcccacactgtaccggctcattgtccctatggccagttcgagtaaggggatctccaggtgacccgagaaagccgcgtgcgagagcacaagcactctcaaggtctggctcaaggggcaccgcaagaaccccttccccaccaaaggcgaggagagaatgctggccaccatcaccaagatgaccctcacgccagtccccaccagcttcaccaacgcccaccggcacctcaagtagagcacggtgaagtggggcgcgcacagcaaggaccaggagcacggaggcctcttcgacagcgacactgagggcgaccccgagaaggcagagattgacctggagagcatgcatctccataagaccaacacccacgatggcgaccagaacaacgagggcgacgaagacaggactgaggaacatgcgcccctgccgccctcacccggaaccagggctcccggctggcagcgccaacgtgctcaaccccaaggctcgctcttgggtctggccaaggaggtcccagagcctggctgcaggcgccggttagccccagcgctgcagcgggcggcctgcagggtgagccacgcggggaagtccaagatctggtggctgcctagggcagcctcgcgcccgcagggcccgcccaccgctttgcttacgccgctgcccgtgggccaccccggcgcgcagggtccccagcccgcgcctccgccacagccggctttcccgcgcagccacggactgcactgccgccacgccggcaagggctccagctggacggagggggccttcctcgctccgggatccctgtcccactgtgtggcttcccgaggcctccccttcctgcgccaccaccaccgcagccgcccgtcgcggtggtcaggggcgctccgcggagaccgagaccaggccccggcccgcagctccgcgcgttcccaggcgcagctcctgatgccaagttcacttggaccccggctgagattagagaggcctggcgaggtgtgggggtgcgcagggagaatgggctgtggtcgccatggtgcgtgttggtcttgtggagatggatgctcctccgggtcaatctctgccttctcggggtcgccctcagtgtcgctgctgaaaaggcctccgtcctcctggtccttgctgtgcgctccccacgtcaccgcgttctccttgaggggccggcgggcgttggcgaaggtggtggggactgtcgtgaggatcatcatgggcagggaagggcgcgcggcagtggcctcgagccctgggtcttctccttcctgaatttgcaaagccaggcgaaggccctcgtgctctcccagagagctgcgctccacccgcgggcctgcctgcgcgtggggagagcggggaggcggggacaggagacctgagcccctgggcgcccctaccacgtgtcccccgtcccaacactggacctcttcagattccttgccgagaggggcctcgtcccaaggctggatgcgccgcgcagcggtgaaagccgccctcgcagcccgcaggcgaccagtgggtgctgttggctttcgccccggggagggaacgggcttgggggcactggcggcggcggagcgcggcggggaagctgtgggggtcgtgcgatggttatggagagtgctccatccgccaggcctgggctctgggcgagctgaggagaccggagtttttccccaggagggagccgcgcaggccggcgacctcttcccaaggctctactgctggaccgcgcccgcggcgccgctcccgccccccttcagcgcactctgcgcctctcgctgggtatggccagctcgcagtgcgcgtttatgctgcggtaaacgcattgaaggaacgcacagcttatctaatagggttttgaaataattttcggtatgccagctggggtgtggtttgcccaattctgatcctgtttccagagaacacagctgcttagacaatctgttatcttcgcgtcctgtcttccttttgacgccagaacatcctagggatcaggggcctctcccatgccctggaaccatcctctcacggtgctgctcttcactggtgccaataacagagctcccgcaggcaggcctggatcagtggggactggggccctgaagtgagatggagcaagacagagcggcccttgggagaggggcatggggcggccctgtgctttagactcggcaccctatggcttgaggaggtgacactgtgtcgacgtgcgtttgaagggaggacggctgaaggtacatgcagtctcccggacgtcacaaactccgcggacgcgggtcacacccgcgcgcacgcgcagcaggggtcttagccacacaggcgcacggcggggcacggcggggcacgggccctgctgcaaacgggcgcgctcccttctgggcaagcaggtgcgaggcgcgcgccatggaacagcccttagctgagtttcggtttgcgcgcaaacggccggcctggccgcccaacgcagcatttccagccagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgacatctgtctctcgcatccgcactgatccgagctttaacattttctttccagcccgcgaaccacgcagctccggactccaggcaggaagcgagggtcagggtcctggaagaaagcactctgtccttgaattattcacccctaattgagttatcgtgacaccctgtggctttgggaaacctctccacaaccaagtggagccacagccctctgctaatgagggtagaaggtcgaattagatacacatcaaaagtggcagtaattaagccttcatttgatttacacctggggcacatgcggctcatagcccagatagcctgtgacttagaaatgggtttgaatagaaaatctacaaaagtatgttagctgtaactgccggtggtggcagaagcttgttcaagttcaatagtgaatgttcaagacaaaaacaacaaaaaggatttagtgtaaccttttcacacgtaatttattttggtaatctcttattttgcagatttaatctgcatccttttgtgttttcattttgttttaaccaacgagtaaaatggtaaggtgacttgcagtgagactgaaatgtctatgtggagatacaggataaaacatatccagggataagtgttttgcaacaagctgtgccaagggtttattcctcataagtgtaataagaactaaaaggtttttgttgttggtggtggttttttttgttttttgttttttttttgagacagggtctcactctgtcacccaggctggagtgcaacgaacggcgtgatcttggctcactgcaacctccgcctcccgggtccaagcgattctcctgcctcagcctcctgagtagctgggattacaggcatgtgccaccatgcccggctaatttttttgtacttttttagtagaaacagggtttcaccatgttggccagcctggtggtgaactcctgacctcaaatgatccacccaccttggcctcccaaagtgctgggattacaggcgtgagtcactgcgcccagccaagattccttttaaaattaaaatgtactggaagagaagtgtaccttgctcaccttaaaattatttcccttaagttcatctatttttgcacaacatttgatttgagggaatttttaaaaattactgaacctattgttactcaattttgatttgatattctcagcaatatacaggattccagctgacttgcagaaagatgaagagtgcagcagcacagttcaaacattagaactttcttttttctttctttctttctttttttttttttttgagacagagtctcactctgttgtccaggctggagtgctgtggtgctatctcagctcactgcaacctcccctcccgggttcaagcaattctccttcctcagcctcccaagtagctgggaccactggtgtgcaacaccacatccagctggcctagaactttctgagtaaaacaattgcttaagattttagaatcaatttcccttattctttttctctctgcagttaaaaaacaatgtctaacccatgcaatgagcttttgactatatgcctcatttcaaaaggaatatgagatcattgagttggacccagagaaactgaactcagagaaaacttccattattgagaacccaaaagctaatggccagacaaaaggatgagaagaaatgctggacctccagtttgttattaattgctcttttttgttttgttttgtttcgttttttattgagatggagtctgtctctttcgcccaggctgcagtgcagtggtgcaatgtcggctcactgcaacctctgctgtccaggttcaaacgattcttgtgcctcaggctcccaagtagctaggactacaggcatgcgacaccacacccagctaatttttttgtatttttagtagagacggagtttcgccgtgttggtcaggctgatctcaaactccttacctcaagtgatccacctaccttggcctcccgaagtgctgggattacaggcgtgagtcaccatgcatggccaattgctctgtttttcacaagggactctgccttaagctcattttcattgacttatcatttctgggtttgctctggtgtgaaaattctcattaaatttttttcttcagattatcgctacttcagaaaaaataaaaactacataatttataattcatgtcacaaaattttgatggcacactgtggcctgtcagagatttctttaacattcctttttgtttgtttggttttggcttttggttttttattaaaacagctttactgaaacatgatttatacactatagaatttatctgttttaacatacagttcaaagattattagtaaatttactgagtcatgcaaccatcactacagtccaactttagaacattttcatcactccaagaagatgcctcatgcccattagcagtcactacacatttccaccccagccctatgcaaacattgatctactttctgtctctatacatttgtctgttccagatgtttcatgtaaatggaattatacagtatggtaaacatctttttcatctacttatttttatattcaactaggtttaacatgtaaccataaccaaatatttaaattttctctccaggagcttgaaaatatttatttttcttgatacttacttcgccttctgatttctgttttttatactgaaacagtcttttaaatgatggcattcattgattaattctttatttttctcttctagcagaccttctttttcactctcgaaacagcagccttggatattaattactatttgttcattatcccctttcttatgagcaccatctagttgctgttcaagctacagattttcatgttgtagttgagatatccactcgtctacatagtcttgctttcctttatctgatgctgtgtttggcttaggtcctttggcacacttttttttgaggcaaaagataacaataagttactgaacaactttctaaagctggaattaaattcaataccctaaaaagtaaactccatgagacaagaagttctctcagagaattttgtattgttcagatggccaaattaagtcatcaaggccatccttaaatgtgttcgctttttgacctttttcttttgacgctttcttcgcaggcctgtcatactcgtctttctctttcctgggaaattgctgatggtaagttttcgcaccttgattttgttgcattgatccatcatcatcgtcagcagatgtactattatataggttttctgatacttgtatatatatatatatatttttttttacttttgtgcttcttcctccttcaacctgtggttatttattttcacttttctcaggcctttcttgttcttcctttgaagtcacttctaagtcttgttctgctctggatgtttatacgtcctttctttttactgcattcttcacaacagactcttccatttcggtggtaggcttcaaggaaagatgttttacaggagacacttctacttttaccatattttttttcttttttatatgaaggttcaagtaaagactctgaagcagtctcagggatatactgcttggtagtaaaagtcaagtcttcatcatctagtttacggcatgaatcaacacacagttgtttgaaaatgctgaatgcagatttgtcagaactccctgaatcttctgcacttgctcctccttctctcaaacttgcattctttgatgcttctggattgtcattttgaagaccattttcaagtatctttttttttatgttgcaaaatttgttgttgaatgctagtcaaaacaccacaaatagcataattgtttgctgtctgtccatacatatcttgaataaagacagtaatattttgttgaagaatgccaactatacctaacgagccataatgtacagcaggcgtgaaggctgttcctctcaacctatcaacagcatgtgcatttgcttgtttcttcactaaaaattccagcatttgctgtcttttgcaaactgcagcaagtaaaagtggtgtgtttccatcattgttcagcacttcaatatccgtatcatgggaaaatagtttttctaccaggaatgtactctcattataggacagcatagtggagagcagtgttgctgtagacatccacgttccagcagaacgatgccacaaatctcttcctggcaatgtacagcctcctcaaaggcatcccattttgtttatcaccaatgtcaatgtggcattttcagttcaccaggagagtccccacttccacatggccattggcacaggccaaacgtacagcagccctgtccatccacagctgaagggatagagaaactgccatacagatacacacagagtatgcttcagccataaagctttgggaaatcctgtcattcgcagccacatggagaaacccagaggacattaggtccaagaaaatgagcctggtggagcaagtcccacactgcgtgacctcaggcatgtggactccaaaaagctttatctcctgcccatccacagatgaagggatcaagaaactctgatatatatacacaaaggaatgttctttggccatcaagataattaaaggatgtcatttggaggaacatagatggcccgccgaggctgcggctgcctcatcctgcactgtggatggaagccgctgatctgacaggaagtggagctcaggtggtaatgctcgctcttgctgtgctgccaggttcttaacaggccagggatgatactggtccaggggtgggggagccctgctccagatgacagccagagtagtcttaaatgtaagttggattgtttgttccctgcttagacctttagccatttcccattaccagaatcttcggcgtggcctgcgtggccctacttgatctggcttctgtcctcccaccctccctcgttagcccccatcatctcatgctactccccctcgcccaggccactgcccagatatattcttctccttgggcaagaagttctgtgcatgcaggtcaaatctgaaagggacatttctttctttaatgagtgtcagggatgggggatgtggctgatgatataaggggccctccaatcagactttctaatctaactgaaaagataattacaatgttgatgctaaaaaagaaggttctggcaaaatagaacttctgaagcatcataaatcagatgactaatatttgtgatccctttttaaattttcatgtgaagaagaataggggatgtaactgaagaaatgaactaaaagttcttctatgtattgataacctaagtgtgggatgctgtttggctctggaaacacgtggcctcctgatacttaataaacaatctagcatcacacatgacctgtattaaaagagacacttcagtgctgaatagtttggtgctcaaagggcaggagagccagttagtgcttggggaggcagagggggaaccttacctgatggccagggacgttgggactgactcagtccatgaactgtgcttacctggaagaaaggcaaggagttgaggaagagagaggagatggaggcaattctaggcctgagatgggtctgagaatatctgtgggtaataagaccaattaagctagagtagaagggtcatttgtggagcaaaaggttgtggattgtgttgtacatggaatttcttaggccactgtggctcttagcagatagtgaaatcaatatagaggatcttgtcccccattaaaaatgttttgttttgttttgtttttttgagacagtcttgctctgttgcacatgctggagtacagtggagtacagattcttttaaaaaatacaagttaaagattgtgatagaaatatgaaaactggccgggcgtggtggctcatgcctgtaatcccagctctttgggagcccgaggcagggggctcacctgaggtcaggagttcaagaccagcctggccaacatggtaaaacccccgactctactaaaaatacaaaagttagccaggtgtcgtgatgggtgcctgtaatcccagctacttgggaggctgaggcaggagaatcacttgaacccgggaggcggaagttgcagtgagccgagatcgcaccattgcactccagcctgggcgacagagccagactgtctcaaaaataaaattaaaaaaaaaataaaataaaataaatagaaaaaaaggaaaaagaaattattaaaactgtcttagttttgattcttggtttaatccagttcaaactggtctaagtcaaactaaaggaatttataataaggacacaagagttttgtttttgcttttgtctttttcacagactccaggagtagacatacaggccaggtctcacatgtaaagcatcagaacacctttagaaaggcaagcagcacctctctgtttcttgcctctgcatctctctgtgcttctgtttcattttctttcaggaccttctgctttgcacaaaggtggtatgcaatcagaagacgtctgaggagacaagtatgcatctcccaccacaacattatatgatgcttggagtaaaaacagtcctccctgttcctacccacgaatgtattattcaataaagattgctgccaggcatggtggctcatacctgtagtcccgcactttgggaggctgaggctgggcagatcgcttgagaccagggtttgagactagcctggacaacatggtgagccaccatctctgcagaaataaaataaaataaaattagccaggtgtagtggcctgtgcctatagcctcagctacttgggaggctgaggcaggagaatagcttgagccctggaagtccaggcaacagtaagccatgatggtggcactgcactccaaactgggtgacagagtaagaccctgtcttaaaaaaaaaaaaaaaagattgcattattcaatcttttttcccatatataatttatatagttacataattacattctagtttttgcacatgccgagaactacatataatttagtagtatgctgttttcacttatatatcacatatattttcctatataggtatataatatctatatttgtccttttccatttgactgctgtgtttcttaaattgatatactgtgatctaagccagttacagattggtatggatttaaattacttcctattttctgttttattaacaataaacactgttatgatatagttttcatttttgtttgtttggtttttgatcatttcctgtggaagtattctcaaagctgaaattactgaattagtgggaacaaacatggctgtctttttaaatgttttgtcagcttactctccaaaaggattacaccaagaggtattgccactagcagtagttaagagtttgtctcaccatgattacaaatttttcaaaattggtagcttattcacactgattggaacatatgaattgttcaatattttataatatgtatatgggaaaacccttatatagattaatcaagaacatataagtatgtaataaattccatactggattacatcgatgatccttctggctctgcatcttgaaacctagttaagctcttttatgttaaattcacccggatagagttttggaaaatacttgctttttatttctgaaagtttttgcaaaggattaggtttggttttatgaaaagtttcgtctctgaaattatctgcctagactttggacaaggtgttctattaattgtcaaatacaattgaattgaatcacatttttctttctaggttactttataaggtgttcctacaggtcataaaaaaattgcccacaaggagccaaattactttattcatggatctaatattgctttatagtattgctatataggtttagataattatgttgtttcaccttcagtagtcatattttagttataggtaaagtcattcctagttaaaatagtatgtaaagcaaacacatttgaaatcaccagtattcgacatgttttgctattacttacaagtaacaatttacattattttaatgttgtaaatagttgtggaatttagtcattttctgtatattgaattaattactggcattaaataagtatcttctctctttagtagcttaactcatttcctgaatgtacccatttgatatcatacttttgattggtaaagtcacatgtaaatatcttttttactttttataaaataatgtcataaaaatatggaagattttctggcagacattattagctaactgatgacattttcagtaagtgccaaaaagtaatatatgaatatataaaacatcaaatatttagcataaactttataaatagcagaaatgattagtagaagaaattactcacatattgtctgctaaaataaatattaaaatttgactacatgaaaaaatatagtttcttgagctgatcaaataaattgatcataattcttcctcgttttgttttctgtgtctgtggaagtcatagcgaatcccgaaaatgtatagcttgaattctgttgggttttttttttctttattacttagtttacatacatttttgtcctcctttgaacttactttctccagacttgggtatgtcatgggcataaatcaaaccactcagatccacttctggaggttgatgttggttttaaagcaggtccttgtggcatccgttccctttccattgctagtcagtacagagcttaccttttatcaaccagataaaaggttctgatgcaaataatttgacaacccattagctagaaaactatttcctgataacttaaaatcgaccgaagccttcccccatatgtaacactgttctgccattcccttcatttttgcagtcctcctttgtatagccttggaaaacagatcagcgaggtagcagtgaaagacatcatgataccaaatagaaacaaggacttggaagacacattggacctcttaatttccaggccacttgatagtagatacagttccttacaaaagaacatggcttcatcttgggaaaagagggtgctggaggtgagggaagatgaattagccaccaagacagttcaccttgcaattcaatcatttaggtctaactggagaatgattgctgccatgttccagaacaagaatgaaagcctcgtttcacaatgaaaaggtgaatttatatcttctgtgttagattctaggaaaaaaggaagtaaaagagatacagaacagtcctttcatccctccccatctgcactttattcttcctaactacaaatcccatgctgaaattctactgtacttgataagcatacaatcatattcagggctctgccaggacaatattcttttttttttttttttccttgaggtggagtttcactctgtcacccaggctggagtacagtggcgtgttcttggctcactgcaacctccgcctcctgggttgaagtgagtctcctgcctcagcctcctgagtaggtgggactacaggtgtgtgccaccatgcctggctaatttttgtatttttaatagagacggggtttcaccatgttagccaggctggtctcgaattcctgacctcaggcaatctgccggcctcagcctcccaaagtgctgagattacaggcatgagccactgtgcctggccgacaatattcttaagtataaagaacatataatagttggaaaaatctatgagcagaaatattttaggggatattttgttatatattcagtatttctataaatgttttcaaaatatacaaaattttgaatgacataatgctttctgtatttcctcttctccacttgggcagttctgtgaacacaaaacatcccctcctgctctgatgtttcactttttatatggttttgattggtgtccccacccaaatctcatgtcaaattgtaatccccaatgttggaggtggggtctggtgcaggtgattggatcatgggggtggatccttcatgaatggtttagcaccgcctctttggtgctgtctcctgatagtgttctcatgagatcttcctcctgctcccaccatgtaagacacgccagcttcccctcactttccaccatgattgtaagttgcctgaggcctccctggaagaatccactatgctttctgtaaagcctgcagaaccatgagccaattaaacctcttttatttgtaaattacccagtttcaggtatttctttatagcagtgtgagaatggattaataaaactttccaggaagatcatttcattccccattctttgtccctttccatctgccctttattctttattgattcccctggtctctgaccacccacctcaaatttttaccttatttattttataatcaattgttccatgcgttatcatgctaaatataaaccctttttatgatgatagacatcatgactaataacttctgtaatagtgatgaggatatctgaaaaacatatatttaaaaaatagatacaccatagatatgacatctatgactggtataagaagaaggttctaattggaagctgatacagaaggagatcagcttgtctcagagcacttaataacctgaatctcacccaatacaaagcacaaaggctgaagacgtgatagcccttttaaagtgagctaccagggattaaccactaaattttagtaccattgcatatggtatttgtatattgtatctctgagttctgtgagccaaagaagaaaaggttgatttttggagcaagcatctttaccatgactaggcaaaataaaaaagaaatagaagtcagagttgatagatgtccactatcaaaaacaacttaccttcggctgggcgcggtggctcacgcttgtaatcctagcacttcgggaggccaaggtgggcggatcacaaggtcaggagatccaagaccatcctggccaacatcgtgaaaccccgtctctattaaaatacaaaaaattagccgggcgtggtggtgtgtgcctgtagtcccagctacttactcgggaggctgagccaggggaatcacttgaacctgggcagcagaagttgcagtgaactgagatcgtgccactgcactccagcctggcgacagagcaagactgtgtctccaaaaaaaaaaaaaaaaaaaaaaaacaacacttacattctaaattagaattgagtggctgagtagctctggaataaaagagatctggattgcccatgaatgtgaggacacatgacatacacctctggagttatggagacagaagaggtcaagactgtaacttctgagtgaatacttctcatggggaaaagtaagctgggagaaaagctaatattacattgttggtagcataacccacaaacacaatttaaaaattcctttgggacataaaatatgttaatgtagcatatggaaccaagatgtaataactgtagtagttccttctggaccaaaataaattgctaaccacatacataatttattttcagaaccctcaaggtattatgcctccagcatgcacattctaaattagttaaacagaggaatcaagaaatggtcaaaataagggtgagggaagcaagagtttctaaagctatcacaagatgttgtagttgtcatctctagaaatttaaacagcagggtaaactttctcagaaagatgtatcataggactatctctagtcaaaaatggttgcagaatgggcagaaatctcagaagcctaccaaaaaggtaatttaagcaaagaaagaaaaaaaggaagggagtgaaggaatgagagagggagagataagaatttcctaccaccaagttaaaaagaaaacaataacaaaactttaggagactgtaaagtcattgtgtctcagacccaagattggtttctataagaataaatgtagtcgcagccaggcacggtggctcacgcctgtaatcccagcactttgggaggatgaggcgggtggataacctgaggtcaggagttcgagaccagcctggccaacatggtgaaaccccttctctactaaaaatacaaaaaattagccaggcgtggggagcgcgcctgtaatcccagctatttgggaggctgaggcaggagaattgcttgaacccgggaggcagaggttgcagcgagctgagatcacgccactgcacgccagcctgggtgacagagcaagactccatctcaaaaaatatatatatagtcttagttttacacagagatgcatacacatatacacaagatgtagtgattgagactcttaaagagtaaaacaaaatgtatgttaactggatatctgagaaaaatgattat

SEQ ID NO: 174 - DNA, 4349 bp, Homo sapiens
gttaccatgtgtgtttatcacaatcaggcattgagtgaacgacaggaaaacaacaaaagacacagctggaaaatacatagtttctttaataaccatggatgtggaaacacagagactgttacatagtgctggggaaaatataacatgttccccagagtttcacggtggggtggggggcagtgggcgaaactacctgtgaggagaaaagcttgtacttattgcaaagcattttgtgccatttagttgttgcaaagccattttgtgccagaaagcttctacttatcacaagaagttccttttgccacattcacgtctgaaggagtgggtgggaaggaccccatcctcccacacacctgacatttctggagactcctgcgacagacatcctccttgctcctgaggtgcaggtcaagcccagagcatttggcagtatttgctgtgatgctgggttagacaaaggcaaccgtcccaggagcatctcccactgacccagatttctgtctgtttcagtgaaactgtagatcataaccacactttgtacttaatcacaaaatagttctggtgttttaggaagcttttggcctagaaatgaaaaaatttttatagagcgaaaaaattttatatagcaaaaaaattgttaacagctttcttttataatccaaaatttattttattttatttttatttttattttttgagatgggctgcagtgcactggtacgatcttggctaactgcaacctccacctcccaggttcaagtgatcttcccagctcagcctcccaagtagctgggaccacaggtgcatgccaccacacctagctaattttttgtattttttgtagaggccaggttttgccatgttgcccaggctggtctcaaactcctgagcttaggcaatccacttgccttggcctcccaaagtgctgggattataggcatgagccaccaagcctgggcacgttcttactctgttagatttttatgctgcactgcctcctcctgtctagaacagtagctaactgtctcctggcccacagacacatccctgatctcatcttgcctttggacacaggtagataccatcttgttctcttaaattttcatttcatttctcaggttttcgtttcattcatttctctttttttctttttctttttgaaacggagtctcactctgtcgcccaggctggagtgcagtgatgcaatcttggcccactgcaatttctgcctcccaggttctagtgattctcctgcctcagcctcccaagaaggtgggcttacaggtgcccaccaccacacctgggtaatttttgtatttttagtagaggtggggtttcaccatgttggccaggctggtctggaactcctgacctcaggtgatctgccagcctcggccttccaaagtgctgggattacaggcatgagccaccatgcctggccttcatttcattcatttctgttgtaagcttagaagtagcagcctcttcagctggggtgggtgacagtggtagggaggccatcctggccatgtgcccagggcagttatgagtgcttcatgtcttgtgttaggggatgacagagtaccctctgggatgcacacctagacacaactgacgactgccctttttattccatttttgtcgttacaggaaaagtcttgcacgaggagcatgttgaactcttgatggaggaattcgctttcctgaaaaaagaagtggtggggaaagacctgctgaaagggtcgctcctcttcacaggtcagtgctacgtgggatcacaggtcacatgtgaggtccaaagaccagccagattctttcctggctctctgggatgggagcttatattcatttctgctcaagactctctgactcagggccacttaattttcccagatgggatttaattccttggtggcccttgggtaaagagtatgttagaaatctcaagcatatttgtgctctgtcccaacctattaactagttggagattatttttcaacaggaagttgtacattaaaactcttttaaaaggatgagaggtgcttggagaggagaacatttttatacttccttgcaaagcaaatataatatgaagagctcccttcctcctctagcaagttacaaggacattggcagcaaccacagtatttatttatttatttataataaataataaatatttacttattctgttcttactctgttgcccaggtcttactctgttgcccaggctggagtgcagtggtgcaatcatagctcactgtagcctcaacctcccaggctcaagcagtcctcccacctcagccttccaagtagctggaaacacagatgtgcgccacaatacccagctaattttaaaatttgtgtaaacagtgtctccctatgttgcccagcctcatctcaaactcctgggctcaagtgatccacctgtcttggcctccaaagtgctgggattacaggcatgagccaccgtgcccagctgaccacagtatctgatctgtatttgtagctgtttacttgatgttggtcactctttgagcagctccgttagcaataggaaatgggcatgcaggaagctcctgctcttgtggccacttttggatgggctccttctctggccgtatcgttgggcacctgggccaccattcctgagggctttcattacagaaaggagaccctgacatggcctggcatttttgcacggtaaagccactgatacatagtagaacctcatttcaaaatctgtcttcatccttgaaaatggtaatataatgagagtacaaaccattaatttgtacaagaaactgtgttaagttaagtaagttaagtacaagtaactgtgatgtgcattaatccatatgacaatcctataaagtggtattcactacccccattatacagataaactgaagttcagaggcatgagtggcttcacagaggtaacgtagcggtcatgagacagagctggattggagctcagctctctaagtggctggaactgttgtgggtggctgcttagtattctgtccaaagaactaggctgggcatagtggctcacgcctgtaattccagcacttggggaagctgaggctggtggatcacctgaggtcaggagtttgagaccagtctggccaacatggtgaaacaccgtctctactaaaaaaaaaaaatacaaaaattagtcgggcatggtggcacgcacctgtaatttcagctacttgaaaggctgaggcaagaaaatcgctttaacccaggaggcagaggttgtagtgagccgagatcgcaccactgcacagcctaggtgacaacgagactctgtctcaaaaacaaacaaacaaacaaacaaaaaagaactagagcagacagtaaccagccctggggaagtctttttgttttgtaagtttgatacttaggccccagtgatttcaaaccatattgtctatgaaaattctaatttttgtttggttttatatataacttattactttttaagaatatactcattgttattagtcattgttttaagtgaatatcaaggtcataagaaatgttttgtttataatgtaatgtaacagatatgaagtcttttaaacttaggttatgtttaagattttggctggaggcagacgggagcagtatcttgaccaaatggatttctcacaccaatactcttttttatgtttatatatatatatttttttgatatagggtatcactctgtcacccaggctggaatgcagtggtacaattatggctcactgtaacctcgaactcctcaggcccagatgatcctcccaccttagcttcctgagtagctggggctgcaggtgtgcaccacgacacccgcctaattttgtgtgtttttttgtagagacagagtcttgctatgttgcctaggctggtcttgaactcctgggcgcaagcagtctgccagccttggcctcccgaagtgctggtattataggcatgagctactgtacgtggcctttttaggcttactgcaacctctgcctcccgggctaaagtgattctcctgcctcagcctcccaagtagctggggttacaggcacccgtcactatgcccgggtaatttttgtatttttttttactagagacggggttttgccatgttggccaggctagtctcgaactcaagtgatccacccaccttggcctcccaaagtgctgggactacaggcgtgagccaccacgcctggccccaatactcttttgagtgtacttttttgttcacaagattaggaagactaagaaaacatttaacattgtatcaattttcttgatattgaaatagctcaaaggtattaccattttctccatagctattataa

SEQ ID NO: 175 - DNA, 3181 bp, Homo sapiens
acatagtagaacctcatttcaaaatctgtcttcatccttgaaaatggtaatataatgagagtacaaaccattaatttgtacaagaaactgtgttaagttaagtaagttaagtacaagtaactgtgatgtgcattaatccatatgacaatcctataaagtggtattcactacccccattatacagataaactgaagttcagaggcatgagtggcttcacagaggtaacgtagcggtcatgagacagagctggattggagctcagctctctaagtggctggaactgttgtgggtggctgcttagtattctgtccaaagaactaggctgggcatagtggctcacgcctgtaattccagcacttggggaagctgaggctggtggatcacctgaggtcaggagtttgagaccagtctggccaacatggtgaaacaccgtctctactaaaaaaaaaaaatacaaaaattagtcgggcatggtggcacgcacctgtaatttcagctacttgaaaggctgaggcaagaaaatcgctttaacccaggaggcagaggttgtagtgagccgagatcgcaccactgcacagcctaggtgacaacgagactctgtctcaaaaacaaacaaacaaacaaacaaaaaagaactagagcagacagtaaccagccctggggaagtctttttgttttgtaagtttgatacttaggccccagtgatttcaaaccatattgtctatgaaaattctaatttttgtttggttttatatataacttattactttttaagaatatactcattgttattagtcattgttttaagtgaatatcaaggtcataagaaatgttttgtttataatgtaatgtaacagatatgaagtcttttaaacttaggttatgtttaagattttggctggaggcagacgggagcagtatcttgaccaaatggatttctcacaccaatactcttttttatgtttatatatatatatttttttgatatagggtatcactctgtcacccaggctggaatgcagtggtacaattatggctcactgtaacctcgaactcctcaggcccagatgatcctcccaccttagcttcctgagtagctggggctgcaggtgtgcaccacgacacccgcctaattttgtgtgtttttttgtagagacagagtcttgctatgttgcctaggctggtcttgaactcctgggcgcaagcagtctgccagccttggcctcccgaagtgctggtattataggcatgagctactgtacgtggcctttttaggcttactgcaacctctgcctcccgggctaaagtgattctcctgcctcagcctcccaagtagctggggttacaggcacccgtcactatgcccgggtaatttttgtatttttttttactagagacggggttttgccatgttggccaggctagtctcgaactcaagtgatccacccaccttggcctcccaaagtgctgggactacaggcgtgagccaccacgcctggccccaatactcttttgagtgtacttttttgttcacaagattaggaagactaagaaaacatttaacattgtatcaattttcttgatattgaaatagctcaaaggtattaccattttctccatagctattataataccttcataccttattgccacttacacatcaggtagttataagaatacaggcttgcagggctaaaatactttgattcttctacttttaccagactactttaaatcactaaagaggatatatatatatgtatatgtaggtatgtgttgtgtgtgtgtgtgtgtgtatgtatatctacatatgtgtacatagatgtatatattagaagcctgaaacttttttattatcctgtttggctggattgactgctgtttccagtagaatgttttactaaaactcaatttaataaacaggaaaagacagagatgcttttatgatagagttgaagttcagccacctgagttttcatcagtatcattaatcacgttgcctgcctaccacataaggcaaggtcccattgtactgatcactcggccacatcttttcacacccccgccacccccacccccctgtcctgctttccacttggcattcctgcttcccagttcccacagcatttgtgatttcccacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaaggtaagtcatgagaagccatgaggaggaggaaatttaaggacatcctagtacatttgcaggtatgatccaaagggagccccgaggggctagaccctcactcccagctccagaagggctgtctgcttctgcagatggagtgctgagattgcacttgtgttgcctcatctcatcctctcagcagccctgtgaggtaaagaagacaaacataatcccatctgccagtcagtagacagaggcttacagaatgccagcaggttgcctaagtcatgcaagtcattcatagcagattagtagtggaaattacattaccttggctgggcgtggtggctcaggcctataatcccagcacttggggaggccaagggtggtggatcacctgaggtcaggagtttgagaccagcctggctaacatggtgaaaccctgtctctactaaaaatgcaaaaattagccggtgtggcggtgcatgcctgcagtcccagctccttggcaggctgaggcaggagaattgcttgaacctgggaggcagaggttgcagtgagctgagatcaggccactgcatttcagcctgggcaacagagcgagactccttcttgaaaaaaaagaaaagaaaaagaaattatgttaactctgtgacctgatttttttcctgtgttttcttatgaaagttttcgggcatattgtgaagttgaaagaatttttaagtaaacacccatccacctactccctagaccctgccattaacactgtacatgttccccgcagggccacacattcacccctcagtgcagccagagtgtgagggtctgtgtttcagctttagcatcccatcaccctgtcacactgttcccaaaacattctgactta

SEQ ID NO: 176 - DNA, 2275 bp, Homo sapiens
actcggattttatcatctattcccttttatcctgtctttgttcagcattgatcacagcccacccggtggattttgacatgtctcaacccagggtttgaaaaccagtgatctgtacagaagttctcacagaaagaatgatgtctggaatttgctgtaaaatacttcagtaaaacaacaacaacaaaatgctgtggggcacagggaggcgtcaccatgagagcagcgggatgctgtttactgttgagactgggagataggagagcatgacatactggtgtgtttgtttgaaaagtaatgaccagcctgggcaacatggcgaaaccccatctctacaaaaaaatacaaaatttaaccagtcatggtggtgcatgcctgtaacccaagctactcaggagactgaggtaggaggatcgcttgagcctccttgaagtggaggctacagtgagacgtgatggtgtcactgcactacctgggagacagagcaagaccctgtctcaaaaaaagaaaagaagtaataaaacagtcagaagagaaacaactgtattttaggtgacagtctggggtcaatattaagttttctgattctgattattgtactgtgttctgtaagaaatggtccttgctcggccgggcgcagtggctcatgcctgtaatcccagcacttagggaggccgaggcgggtggatcgcctgaggtcaggagttcgagaccagcctggccaacatggtgaaaccccgtctctactaaaaatacaaaaattagccaggcgtggtggcaggcacccgtaatcccagctactcgggaggctgaggcaggagaatcgcttgaacccaggaggcagaggttgtagggagccgagatcacgccattgcacccataggctgggcgacaagaacgagactttgtctcaaaaaaaaaaaaaaaaaaagaaaaagaaatggtccttgctcttagaaaatatacactgatggccaggcatggtggctcacgccttgtaatcctagcactttgggaggctgaggagggcagatcacctgaggtgaggagttcgagaccagcctggccaacatggtgaaaccccatctctctactaaaaatacaaaaaattatccaggtgtggccgggcgcggtggctcacgcctgtaatcccagcactttgggaggctgaggtgggaggatcacgaggtcaggagatcgagaccatcctggctatcacggtgaaaccccgtctctactaaaaatataaaaaattagccaggcgtggtggcgggcccagctactagagacgctgaggcagaagaatggcgtgaacccgggaggcggagcttgcagggagccgagatcgtgccactgcactccagcgtggggcacagagcgagactctgtttcaaaaaaaaaaaaaaaaaaaaaaattatccgggcttggtggcgggcatctgtaatgccagctacctgggagatggaggttttagtgagctgagattgtgccactacactccagcctgggcaagagagtgagaccctcaaaaaaaaaaaaaaaaaaagaaagaaaatatacactgacgtgtctgggctcaagagtcatcatttccgtaacttaactctcaaattgttcagcaggaacatagtgatacgcatgaatacgtgcagggagagatgaggacacgcgtgtaggtaaatgttcatttctggcgaaggatatttgcagggcctcttcatattctcacaactcttctttaactttgaaactgcttcaagaaaaaggcttaaaaaggaaagaaaggcaacatccagaagagacagggcagctcagtgagagtctgcgcaatgcctggcctccccaccatggtctcccagggcaggatgcgggcggcagcatgtgcgtcagatcgcgttttcctgctagcagcttctacagcttggtggagatgcgttcctggggccaggctctggccgagcaaaggatctgtattatgccgtgccaggcagcaccacctccctgaagaggtgtctggaactgacaggttttctctgaacagctgtcttgcaatttgaaagacccctacctcaaaacacacaggggaaggaaggaaggcagggagggaaggagggaagaagcaaaccagaggatgggggaccaggagcagctccagccaggattcaggtgacactgggggcaggatgcagtgagggtcaggcaggtgcagcatcgagggtggtcacgtccacatatggcaatttgatgtggggtgtgtggaactcccacgtggagagt

SEQ ID NO: 177 - DNA, 2841 bp, Homo sapiens
ttttcacacagcaagttttctcatctcccacagtgtccctgaacttgccctcattgtcatcctgcttctgcctccctccaaggacagcacaaaggcggcaggcacaggactggctgaagggacaagaaagaattgggagtctagaggagctgtgccacctcaagcaggtcatttcccgagtctgaggtgctggggctcggtcccccaggttctgtgtcctcctctgccaaacaggcattgagccaccagcctccaggacagggcctgggacagagttgtcaccatcatcttcatcatcatcattgttctcatcattcttattgctatagtttggatatttgtcccttccaaacctcatgttgaaatttgattcagaacactgggcctgatgggaggtgtctgggtcatggggcaatctctcatgaacagcttgcttggtgccgtcctcacagtaatggatgagttcgctccctattggttcctgcaagagctggctgttaaaaagaagcctggtggctgggcgtggtggctcacgcctgtaatcctagcactgtgggaggctgaggtggctggatcacttgaggtcaggagtttgagaccagcctggccaacatggcaaaaccccgtctctactaaaagtacaaaaattagctggctatgatggtgcatgcctgtaatcccagttactcaggaggctgaagaatgagaatcgcttgaacctgggagccagaagttgcagtgagccgagatcatgccactgcactccatcctgggtgacagagcgagactccgtctcagaaaaaataaaagagcctggcaccttccctgcttcccacttgctgccaccctctcgccacatgatctctgtggctccccttcaccttccgccttgagtggaagcagcctgaggccctcaccatcctggcgccatgtttcttgtccagcatgcagaactgtgagccaaatgaaacttttttttttggagacacactttcactctttttgcccaggctagactgcaatggtgcgatctcggctcactgcaacctccgcctcctgggttcaagcgattctcctgacttagcctcccgagtagctgggattacaggcatgcgccaccacacccggctaattttgtatttttagtagagatggggtttttccatgttaatcaggctagtcttgaactcccaacctcaggtgatccgcctgcctcagcctcccaaagtgctgggattacaggcgtgagccacggtgcccagcatgaacctcttttctttataaattatccagccttgggtattcctttgcagcaacacaaatggactaagacaggtgtcacctcactactgttgtcatccttgtcactgtcatcattgttgctgccacctttaccatcatcatcctcatcatcgtcatcagtgtgattgccactaggtaccaccagggcacccccactacgtggccccaattccacagtgtggcctgttgtgttgggggtgaatttatgtgggagtgtggagagccctgtccactccctttgagatctggggccagcctcctgcagagaccacagatgctttcatgcgagaggccccttagatgagctgaaatgtctgagaaggaggagttacagctttgattctacatctgtctgaatagaagccatacagttgtctaaacatagggaagagccactgttaccttaaactttatcatcatcgtcatgacaatatcagctgatagatatccagctgttttcagtgtgccaaattctgggccaagtttgctataaaaacgatgccactgaaccctaacaatgccctaagagataaacattatcaccatcctgttttataaatgaggagctggggctcacagctgtccagcgactcccagcacccagggctagcaagctacagctctgggctgccagacactaaagccaagcccacatcactgcactgggttgcagtgttctattccacacgccagaattctagattgtttgagtttgttacaaacacacgtatctttgtaactagaaaataaagatttaaggccggacgcagtggctcaagcctgtaatcccagcactttgggaggctgaggcgagcagatcacctgaggtcaggagttccagaccagcctggccaacacggagaaaccctgtctctactaaaaatacaaaattgggctgggcgcggtggctcacatctgtaatcccagcactttgggaggccgaggcgggcggatcacgagatcaggagatcgagacaatcctggctaacacagtgaaaccccgtctctactaaaaatacaaaaaaattagccgggcatggtgttgggcgcctgtagtcccagctactcgggacgctgaggcaggagaacggtgagaacccaggaggcggagcttgcaatgagtcgagattgtgccactgcacaccaggctgagcgacagagcgagactccatctcaaaagaaaaaaaaaatacaaaattagccgggcatggtggtgcatgcctataatcccagctactcaggaggctgaggaaggagaattgcttgaacctgggaggcggaggtagcggtgagccgagattgcgccattgcactccagcctgggcaacaagagcaaaactccgtctcaaaaaaaaaaaaaaaaaaaaaagaaaagaaaagaaaaagaaaataaaataaagatttaatgggagaaaaaaagatttaaggcaaggatacccttagcttggcatgatggtatgggagcagttgggcccaaaagaactgctagtttaggtataaatgttctatctttttcacacatttgcaggggtgtgaaaa

SEQ ID NO: 178 - DNA, 164001 bp, Homo sapiens
tatctctgactttttgatcgttctgcaatgttttgctctctatcttccagaccgctaatttggtctttaattctatttgcttctcaagccaacctagttaaccttttaagttcaatcaccacatttttaatgtccatgaactttcttgttctaaaagatcttttttcacaacaggctacttagattcactatacagcagctcaaatctctttgaagataccgactaacatgtttttggcttctgctatgcgccccaaagtctgcttactctgggctttttctttcatactatttattctcctcaaatgtctggtgatcctttgatgtgcattcacactttggaataaaagactgggccaatcaacaagggaaaccactgcatgcttccagtctggtattaacgctctcctggggaaggccagctacctgcaggctccgtgtaagaggacagaaagtgtccaatgatgggctttgctttaaggtatacaagtaaacaagcacggaggcagagtgggggacaaacaccaaatctgccaaaacagtctctcctccagtggcgaaggacgttcacagataccgcctgctagagggcctacatttccttcccaggacccctgttactgcaggagcccgcagggatctgacactctgctcggcttctctctcaggccccaacaccccctcaaggatccctccccagacacagttctcagtttttagccagagaccattgtataaatgtaatgcttcgatttcctaaatattactctagggccccttcctgttggtggttgttagtcactgtaaactcagcttttaatcccccccttttcttttgcacctgtgttttgagttacaattgttttgtttttgttttccttttgtcaatataatcccatctgttttcagtcttccaggaattcttcataacttttagtttaatagaggtaggcatcctttcaaattttctaatactattacagatgttttaaaatatttaccttttgttatttaaaaagatttttggcaagagagaagctggatgcatgtgttcagtctgccattttactcctaaaaatccagattgtcctcctgaatgcctaaatacttttttctaatttaaaatgctttattcaaagcaccctaaactagtacttcgctaggaaactgaaaaatattcctcttaattctgcttgctagtgaacagaacagactttaggcctcttgaattcattttaaaagtaactacagtccagttaaacaaggtaaggtccacaaaagaaaagacgtttaagcaacattttccaaagagagaaaaaaaaacacatatatgtaaggtttgatgagacaggcagtcctagaaaaacaaatggtacttcaccagatttcaaatgtaaagatttattcatttacaaggaatcaaaagtttgatccaataaaaaggcagttacaataaatctaaagccaatgaggattaagtttgattttttcaagcttgatttgatttctataaaagtataaaccccaaatatattgcttctacacattatatgcacatcagatgccaagtcaacgagtatttcataaatgtataacataaatatttaagaaagcaaaagagtataaagaaaagatgtggcctttgtcttttaaaaacagaaaatctgaataggaaaaaactatacacgtatctaaatctccacacagagataatgatagacgtagaagatggtgtcatgttacatcccactttttcagctcttacagaattgctacagtaattcacaagtatggtgagggagggagagtagctgaaacaggttgttgttgttgttgttgttttttatctgttattttaggttttactaatggaagtattgagactagaacaaaaagcacatactagatagatacttacctgaccaatcctggcaagaggactattgtctcactcacatggaattttaaaaatctgaaagtcttacataaaaatccaggtttccagtttgtcttgagtagtcagaaaagctgacaaatccagccccacattcctatgggaaatcatcagctggtgtgctggtaaacgttaacaactggctctctatagaagaaaaacaaaagcaaaagcccctgatctgtatagcatttgccatggtgtaaatacacccatcatggctgatttcaagctcccaacgtgatgcctggaaatgacaggcacaatcagctcatggacaacagtggccagagctgagtggtggctgccccttggacaggagttacgggccttccgtcctcactgctccctatagtcttacagtggctgctacctgcactggcaccagcccgccccacccctttctctctcttcacccccaagaattcctgagccagatccaagctggtggtagtgctgggcacaatgtcctcctaatcctcatcagaccacatggaaaaatcattgcttaggtaccacattttaggaggggcactgccaagcctgagtaggtaaagacagcaatgagctcagaagacatctccaacacaggatggctgacagcactggagatgttcacaccagatactgaccggggcagtgactctcaaagtggagagagaagagatgatgggtagggagaagtgcaccaaatgaaaaaaaaaaaaaaaaaagaactacttcatccaaaaattcttgactctgatatgttaaattcaattgcaaatgacattaaccatccacaacacttttatgtgtattaaaggaaaatatggatctctaaggattgtgaaacatttgtttaaaggaaacagtcaccctcctcaagtgtctaaacagctattcagtggaagaatctattttcagcatccattatgctaattaacaaggcatgttattttcaccagtggatatccaatttctaacatttattatgctaatttgatctgatataaaactataaaaatagcagagacactggtagtagctgtctctggagggcagcccttctgattaaaggccagatgtctagccctggatgcccccacttagagaatggcttaaataagcacctaatccacctgatgttttatgaagccttttgaattagaatagactactgggagatggtattttttgatgtcattgttcacaaaagggaagcaactgaaagcgccgacttttagaaagaacagaaacatcagtgcttattttaaacctaatgggagcttaggaacatggtccagtcagaggaggagcgctcccctgtggtgcctgaagcactcgactgtccacagctgccgacactcacctgggaactactgttctgatgatcccagcagcaacgcacaattcagtgcgccagcaccaaaggaggaaggaagacagaggtttgtttgggttggtttttttgagggggggtggggggatgtttattttactttaatcttgaattaggcatccaacttctcctaatttttattctcttaattttttctctgatacctcccccacccagtctactgcaaaggctcttgctataagaagtaatgaaaataggccaggcgcagggtctcatgcctgtaatcccagcactttgggaggctgagacagcggagttgcttgagcacaggagttcaagaccaacctgggtgacgtggtgacaccctgtctctaccaaaaatacaaaaaattagctgggtgtggtggtgtgtacctgtggtcccagctactcgagaggctgaggtgggaggatcacttgagccccagggggcggagcttgcagtgagccaagattgtgccactatactccagtctgggcaacagagcaagaccctgtctcaaaaaaaaaaaaagtaaatgaaaatgttttgtaaactacaaagtattatcaaatagaaatagtattccttggaatttgtacattattagtagcaacagtgatctttaaaatgagtcatttctgctagtgtttaataaattaattccttagagataagcctccctgcaggggctacttcattaccaataaatgtttactaaatgcccaccatatgcaccaaatggtagacgattggaatacaaaagcagaagggagcaggattctcgtcctcaacaggcaaggatctgctatagactcacaccatccttcaagtctggccaccctccccatgacactcccttctatgttgcctctgggttatcttgtctctaattaaacactttggcaaagtgggatctcgttacctggggaagcagcccttttcccctgaatcagttcctttccttcagttagctgaggtacttactgggaaagaaaactccatacatatgaaggggagtcctgtggcagcgtgcacctgagccatcacacacacaagagggcagagccatgaacgggggatgaaggactgtccccgagcacacgctaccacacgtcctgaacgtacggctggttacagctagttaatattttggaaatgctattttattggctaggaagccttttccaaatgaaaatctctttactgatagattagtgaaggtagtatagaggagttttattttgtttttgtttttttaatcagcagaaaagtctttcccgtcctctgggcagacagatagcagagaattacgcgcttaggtttcacagccaggctgcttccgttcaattctcagcactgccacaaccagctaagtgtacctgggcaaactacagaagccctataaacctcagtttccttatctataaaatgggactaattatagtacctacttaataggggtgttctgagaactgaatgagatgatactgtaatccttcaactgaggtccccagacaaatgctcaggagttcatgagaaatttttacttttgttatttcatggagaatcttttttaaaatttgacataagcatcctctgaatcagatggctaggtgctatgtcaccaagtattgctgtaagatttcagtgactatgtttgtatttttctggtctaatgaaaaaaggggtcaggcgcggtggctcatgcctgtaatcccagcactttgggaggccaaggcgggtagatcacttgaggttaggagttcaagaccaccctggccaacatggtgaaaccctgtctttactaaaaaatacaaaaattagctgggcatggtggccagtgcctataatcccagctactggggaggctgagtcaggagaattgcttgaatctgtagggcagaggttgcagtaagccaagattgtgccactgtactccagcctgggcaagagtgagacactgtctcaaaaaaaaaaaagaaaaaaggacagagacaaacccaatatataactgaggcatttgcactaagaaatagtcaaattatgtcaccacaacctgtatgatgaaaaattttacaagagtttgcaagatgaaagtggaggggaaattgcattagccggcaagtggcatgataggtagactaacattacagaaccaaatccggcagactggcagcatatgccacagttgtggaacagaggtttggttgcagcagatcttcatctgttgtgtcacggctagcttttattggctatatttagtttataaatgtgtattctagttatgaagttgtaaagaaactgcaagcataagggccaggcccatttttatgctttatatattcaagtaacataataaagataatcatattgtacttacgtaagggaatgttctcattcttttttttttttttttgaaatggagtctcactctgttgcccaggctggagtgcagtggtgcaatctcggctcactgcaacctctgcctcccaggttcaagcaattctctgcctcagcctcccgagtagctgggattacaggcgcctgccaccacagctggctaatttttgcatttttagtagagacggggtttcaccatcttggccaggctggtctcaaactcctgacctcatgatccacctgcctcagcctcccaaagtgctgggattacaggtgtgagccaccatgcccggcccaggaatgttctcattcttaagaaatgcacactgaattctttaggagtaaggaggaatgatactggccacttactctcatatagaaaaataatacccaactatatatacatacctatgtgtgtatatatatataaaacatgtaccaaaagacagagagaacatgtgcatgatgaaggaaataggggtagataaaaacaactggtgaatctggttaaaggacatgtggtagccaaagaactatagcttctcataactagaaggaatgcacttaaaagttcagatccagagttcccctaggaggatcattattagaccagtgattcgtgtggggaaagggacctgatgtcagatgcacctgggaaggctttgtcagaatgccagcaagtaccccgtctcctctctgaggatcgcggatagcagcgagccactcttatggatgaaaatgcacggcacacccctctggtattttaggatatgaaagtaaaaatcactgatgcagtgatcagataagcctccaaactatccgaaatgatcacagaaggaagtacttaatgaacactacagaagagctggcagaaaaacgatccaaaggccatgttatattgagcattatttttagacttaacttttctaaagtgcaactttacaaaaccaggagtcctcgaaatacatagagaaacagacagacataggcgacaaaacaacaactgcatttcccgtttgggctttcctgatgaaattctcccacagttgcacacacagttgctagaaagcaagagtacagtgctctttccctcactaagggaaaaccagactcaacaccaagactccaaggggaatgggcaggaatgacatcagtatgttgttctctttccagggcaccagaggacttggcactctgatcacaagtaaacacaactactccattagaggcagttcctccctattctaagcctttattattcctgggttttagagtcagtactccagaaaatggtcactccctttggtgaaacctatttgtctccctcctgtgctctggggcatgcctgcccctttgctgtaccatgcctcaatcgagtccaccttgtagatgctgatctactccggcatgtctgaatattaccggctccttttattttcatggcccacgtggcagtcagatcatcccagtgcatacaacggaggagccaggagtaaagtttatcacacgaaggagatgtaaaccaaatcatgttttttcaaactgtcggttccaatgtgttagtggatcctaaaatcaatgtaaggagccatgactcaacttctatttaaatagagtgcaaagaccagaaaagacacatcaaactgcactgtgcaaagtaagggtaaccattgtctcctctttttatttttttaaacatattttagagacagggtctcagtcgtcgcccaggctggagtgcggtggcaccatcacagttcactgcagcctagtactcccaggatcaggtgatcctcccacctctgcctcccgagtagctgggaccccgccgggtatgtgccacccatgcccacctaatttttaaattttttgtagagatggggtctcattttgttgcctacgctggtctcaaactcctgggctcaagtgaccatcccaccttggtctcccaaagtgctgggattagaggtgtaagccaccacctgagccagtactgtctcttaaaacttttggattggttatctcagtatatgtatatgaagatcacaatatgaaatggcttttttgagatggggtcttgctctgtggcccaggcctgagggcagtggcgcaatcacagctctctgcagcctttaactcctgggctcaagccatcctcctgcctcagcctctggagtagatgggactgtaggcacacaccaccacacccagctaattgtggtttttttttttttttggaggatgaggtcttcctatttttcccaggctagtctcaaactcctgggctcaagcaatcctccctcctcagcctgccaaagtgctggcattacaggcatgagccaccatgcccagcctaaaatgcttttttactgtgtgccacagtcaaccatattcaaaagccacagtattagatgctgagagaaaaggagagagaaagagacagaaagatcaggagtgggcccagctgaactagtcacaggagcaaaccccataagaggttcacttggctgatgcagaagccgaccagaagtcaccatgatcttgaggaaagaaatcataagagaaaagagtatatgagtgcaactaaacattacgttatcattaagctgacctggtttgctttcctttttttaaggcaaatgtagactacagcctagaaatataaacatattccatacaagagggccatgtgtccccattataataaaagcttgggttcttaggaatgcttacttgaaaggagtatggtaatcaatgcttcatcaattagtcaaccttcaataatcatctccaaacaaggagttagtgaatttcttggggcagatgcaaacgcaacccctgcaaaagctgctgtccttgccacatcactcacaccagccccatccagccttgctgatcatctgcatattcattcaaaagcactattccctccaccaaaaccctcaaagttttaatttaaagttattttaatctaagtgaggaagtcagcggatgcaattagatcttaaaattagaagatatggttaccaaacttaaccattttgtaaacattgcaataaaatggaatatcatgttaaagacatgccaaggtgttgttttatacattagcaccaagcaccttgccctcccattttcatcaatttaccctatgaagaaacagctggaggctggcacagtggctcacacctgtaatcctaggtgtgaggattattttgggaggccaaggcgggtggattgcctgagctcaggagtttgagaccagcttgggcaacatggtgaaacccctcctctactaaaatacaaaaaattagctgggcgtggtgacacacgcctgtagtcccagttactcaggaggctaaggcacaagaatcatttgaacccgggaggcagagattgcagtgagccgtgatcgcaccactgcattccagcctgggcgaatgagcaagactctgtctccagaaaaaaacagctggaaaaaagctgggacttcccagcaccagtattaccaatcactgaaaggagaggttcctcaagcacaaggaagaacagcaatctcaagttgtatttccattcagtaccttccagggttaccctagacactgattacatcaatgtctcatgagcagtggaatgattattttaagtaaatttatcccttccaggccatccagataagcaactattgtgttactacaaaaccaccattttactatttattttagctctacagtgtactattgaaatatttcttttattctccactagtagacatactgaagccttaatactatcaggtattatagactcaagtcataataggtactgttcccttcaaaatgctgaaacaataacatcctcaaaaatccccaagttttcagttctccaggagcaaaggaaaagagaatcatttaggtcaccttgatgagctgggaaactgatctcaagtagtagaacatttttctgtttgtaataagaggcccaaatcagattacattcacaaggcttttttaaagtgttgaggagaacgttaacctcccctaaagtctgagagcaatttacaacaaaagctaaaatagaattaatgtagggcagagaaagctgagtcaggctgaatcagcccaagtaagtctaagaaatccactgaaagacatcgaaacctaatgttcaactttgtctataaattgtatgacttttcacacacttacataataatacataactaatgaattaggtaacagaaaatacaatgcctggttttcgagctcagcatacttgagagtggtacacataacacaagagtaagaaaggtttcccaaaaatgttaataataattgaagacatctttggacttttttcctctcattcaaatgtaaaaaatgatcctaagaagctgaaaccatgatacagggattctagaattatgccagcccatctctaaagcaactggagtcatttgagtcaaaagaatgttcggctaggcatggtagctcacacctgtaatcacagcagtttgggaggccaaggcggatggactgctggaggccaggagtttgagaccagcctgggcaacatgatgaaaccccatctctacaaaaaaaagaaatagaaaaattagctaggtgtggtggcacacgcctgtaatctcagctactcaggaggctgaagcaggaggattacttgagcctgggaggcagaggttgcaatgagctgagatcatgctattgcactccagcctaagtgacagagcaagttctgtctcaaaaaaaaaaaggagaatgatctaggataaagtctacagtctattttctgattgttagagccttataagcgaatttatcctcattcttcaaaaacaccaatgggctgtgttcaacacagaaggaaagtaagagttcctctttcccttagcagtatcgttttgtttctccgaaaacagctctcccaaaccataggttccaaagggagtcttgcatctacattaccagctgtgcttgtccccacttctatacattttacagccataagcgtctgcacacaaacatattcatgagtcccatgaaggcaggaactgtcccttctttatctttatatgccccttatatataagggttcaatcatcactcactaaattggaaactaggtaggcctccaactggaacagaatgatcaaaagaggagacaagaaagtctttactctccccacttaaagacacaaaaggttaccctgaggtaattatttctatttttcattgtataaacagtattttgttttattattcctaactaaagttgggcattgtaaaagagagaaattcaaactactaccttatataaaaacttctaaactgactatattggcgctcaacaaagtctgcaaatagctattcaaatcagccacttctccagggtcgtcactgctccctacagtcttacagtggctgctccctgccctggcaccagcccgccccacccctttttctcccttcacccccaaaaactcctgagctagatccaagctggtggtaggcctgacacgatgtcctcctaatcctcatcagatcacatagaaaaatcattgcttaggtaccacattttaggaggggcactgccaagcctgggtaggtgaagacacagcaatgagctcagaagacatccccgacacaggatggctgacagctctggagagaggtgatatgcaattgtagaaagtcatatttcttgcaatcttagaggaataaaggagttttgttgttgtttaggtaaaaagccttcggcctgagctgcctctcccgagctccaattcctcagattcccatttaacatccttgaacttcaatttctttagtaaggaataattatacctcaccatcaggtggttatatcctcacaacaatcaaaagctaagtaagtgtgaattatacaagaggttgaaaaaaccttactagatacctcacgcaatcactggtagaatgatgatcttgtaggggtggtggcaggagggtgggaagacacagacgcatgatgataaggtttggatatttgtctcctccagatctcatgtaagaatgtgatccccaacgttggaagcaaggcctagtatgaggtgtttgggtcatgggggtggatccctcatgaatggcacggtgatgagtgagttctcactctactagttcactcaagagctggttgtttaacagagcctggcacctcttcctctttcttgcccttcctctcacatgtgacatgcctgctctccgtcaccttctgccaggagtaaaagctctctgaggcctctccagaagccaagcagacactcatgccatgcttgtacagcctacagcaccgtgagccaattaaacttcttttcttaataaatcacccagtctcaggtattcctttacaacaatgtaaatggactaagacacatgttaatacagaagactgggagaagccctatcagaagccaacaatgtgccaggagagagggcaaggcagtcccaaccaggagtcaaaagctaatcagtaagctcagtacacacgacagcccgttaatcctcatcaacactttgtaggtaggtattgttgctccatgttactaatgagaaaactgaggcttagaaaaataaaagtctaacagccagtagagaggtagacctcagattttaagaacatacacttgctgtctgccaatccaggaaggactaaactggaaagagctcatcttcgagaacttataatgtataaaacgtcaacctaaatttttttgttgttattaatattttagtgcttagaaaaagaactgttcctacatgaaacagtaattcttacaatattgtttagcaagtaatcttaactttgaacaagaacgtttaaaaataaatatattgttgggtgagcaggaaaatcactttaaaatgttgtagaataatcttccaatattgttcctttcacccatccctcaaactacactaatgaacattttttttctcccagtatttgctctttctcagcaatgcaaacataattttcatgactgttttccattatgacacatactgtacatttccaacgacataaatgacgttcgatgattttttttcccatctctagctctctgctggtcaattagtctatcaactaacacatatttatctcaacatctgagacacataaggagtatcttcattccagatcactgatagtaacctgagaaggaaagaacgacctacaattaacggttcaaactctagcatacaaagttaaaatactgattaaggccagacgtggcagctcccgtgtgtaatcccagaattttgggaggccgaggtagacggatcatttgaggtcaggagtttgagaccagcctggccaacatggtaaaaccccgcctctactaaaaatacaaaaaaaaaaaaaaaaaaaaaaaattagctgggcattgtggcaggcacctgtaatcccagctacttgggaggctgaggcagcagaatcacttgaacctgggaggtggaggttgcagtgagccgagattgcaccactgcaatccagtctgggtgacagagtgagactccatctcaaataaataaataaattaaattaaataccagttaaataccagtacccacacttgagtccacgagtttgaaaccagcctgggcaacacagcatgatcccatctcaaaaaaaaaaaaacaaaaaaaaaaacaaaccagtatccatagttaagtgccagttaaaagacttacatgttcttgaaaatacaaatgaggatgtgaagctgttatctctaaggaaaaccaccaaaattaacagcaaatagccagaaaaccatgtagagaagcatgtaattttgttatggagcagaagacaagggatcattaaagcacttaagctattttataatagactcctcacttacgtttttcgtcatcagcatgcaccagagatgctgccctggacaaaacatccaatggcgtctccattcctggttggagcctaagaggaaaaaataaaaggggaaaaaataatttaaacagaattcaaaagactcttagaatcctagtcattaacagaatgagtcctcaaccaaatgcaaatcattcttctaaggatgaaattcttcccacatgaggaaacagaatgggcttggttcagggagagagaaaagggttaaactccatttagtctactaagctaaactttgccaactacaggaagcagctgatgtaggaactaaaagaagggatattgtgaatattcatgcccatgttatttggtgcttatgtttatgtgcatgcataacatgcctgtataaacatgcccaataaaagaaaggttttcagaacaacggctgctctatgaacacagcatcactaccagtgaggtggtgcagcttaacacacgccacgtactcatggaaagctgtgtgagaaacccactggtaggttaattgatattttaagtccaataagaatctttatgttaaaacgtcatgttttgtataatggtatattatataatcaccacctatcatcaatttatctagcatcatgttttttaataagactggatttttattgttgtttccttaaattacagcatactataaaagctaaaacagcaaaagatttaaagctcgaggaaagccctggaaaaccagaatgctttttacccagtttcccttttctgggttatttaaacacacacacagttactggcacacacaccctactagctcaccagctgagaaaaacaactccttaactgtaccactttacagacacttggaatttattcagcattcttcaacacttatggagtacctactacgtatgcaccggtcacaacatgtggcagaccagcttttctttgtaatattcatacctcaggcctccaaagaaacactgatccacgaggcatggtagctcacgcctgtaatcccagcactttgggaggccaaggcgggcagatcacttgaggtcaggagttcaagactagcctggcgaacatggtgaaaccccatctctattaaaattacaaaaaattaggtcgggcgtggtggctcacgcctgtaatcccagcactttgggaggccgaggcgggcaggtaacctgaggtcgggagtttgagaccagcctgaacaacatggagaaaacccatctctactacaaatacaaaaaaattagccgggtatggtggcccatgcttgtaatcccagctactcaagaggctcaggcaggaagatcgcttgtacccgggaggcagaggttgcggtgagccgagatcgagccattgcactccagcctgggcaacaaaagggaaactccgtctcaaaaaaaaaaaaaaaaaaaaaagaaaaaaagaaaagaaaagaaagaaacatagatccctgatcatgcaatatgacttcattcagtaaacgttaaatatctacaaggagctccaggcgggaaaaataaacaaagcccagtagctgccttcgaggagctttcaatctgcacgggaggcaggccaccgagacatctagtttaaggcagcattcttccaaagcattctgcactgggtgttcatattttgtaagaaaaaaacgtttttctatggtaaataagtttgaggaagcctggagtaaaccaagctaagcagcgtattttcctccccgtgcctttaatctcccgttgtggggacagaaagccctgtacacgcgaaacctcgtagacgtcatgagccattttcaacccaaaacgcatctcagggaacatctggggaaaatactgggttagggcaaaatgtgcaaagcgtcaaaacagtgctagaaacaaagtcctacagaaataacagatgaattctgaaaggctttgtgaagaaaacagaacttgagcggaggctttgaagaacgaatataaaagttcctcccccagaagggaagaacagaagcagaatcggtttaacaacacgctgcccaaatcgcctacaagagtaaaatggggacagaaagtaagcgacaaggttggaaatttagattgggaccacatcgtgaaaggactgagggcttcgatgggaccgcggcttgacacgcattaaggagccactgaaaactccatctaagcagaaaagcggcttagtcatccatgcgttctgggcaagttatcctggccgcaccacgtggaacggagtagatagagctcgggaagctgagcgcagggcggacaacgggaaggccagagccgtgggcaagcacgcggagggcagcgaggggcactggcaccggagccgcggggaggcaggaaaacgcagaggcggagctcactgagcttggcaggcagagagaggaggggagggccacggaagactaagagtggcagggaggcaacgacctcctaacacacgcacatgtcttctttttcagagaggatgggtaaaagcagcggtctaagagggaaaacctaacagtgctcacattcctgatcttctttgtaaaaacagaaaagaccatctcctaagaggaaggatttgtgaacttgttcaacaatggagaaaaccaacaagaacttggaactgactaacagaaaaaagtctgctgaactcccaagaactaggtaatattctcttcacccaagccagcttcctattcaggaaagatctgggtttaaagtcttgtgatttggtcgagaccatcctggctaacacagtgaaaccccgtctctactaaaaacacaaaaaattagccaggcgcggtggcgggcaccgtagtcccagctactggggaggctgaggcaggagaatggcatgaacccgcgaggcggagcttgcagtgagctgagatcgcgccactgcactccagcctgggcgacagagcgagactccgtctcaaaaaaaaaaaaaaaaagatcttgtgatttggggtagtaactgctgataagcatcctactttgcaataatacagcatttagactcataattctctaaattaattttaccccattaagttgaaggacaatgctttcaaaattctagacctaaatagattaatacataccttaggttatataaagtatgcacagaaacaaaatatcaaagcataaaagtatcaaatgacataaggtagacccagaattctagcatagcggaatattagacatttaagtttatacagatgctatgaaatcctaaacccccaagcaacttacattcaaagtaggtagataagataatgggtattaaaggttcatccacaaggcacctgccatctgctgcaaccttattaatgaaatcaaccaatgtttattacacaattattctaagctcagcaaagtgcccagaaaaggttaaggagaaacagaagatagatctctgctttcaaggagtcacgctcttgttcggaaactaaattttataagataggataatgacaggcaaaatcaaaaagaggataaacaaagactaaatattatttaaaactaaaatgggtacagtgtcataaaagagatcaatgtcagctaacgtgtttgccttgtgcacatctattttttgtttgggggtggtttgtggatgcgtgtgtgtttcaaaaagccacttggaaaatttccttccccggttgccctgccccaggcagtcactctcctctctggcctccctcaccttcctggatcgcactgtgtttctgtatacttcctaggtgcaaggaccctgtcttatccccagtgcagtcatcctgagtcaacaacagtctgagaaaaggcacaggggcaggaatgagcacctgggacaggtggccagacctgactagctagaactgaaaatccacgttaggaagcagcagaagctaaattcaggtgagcctgatgcgggtggccttaggaaagagctgacagctggccttcaggttgatacttaatgtcacaggcaacaggcagttgtcatcatctgtccctgagctggcccgtgacatgatgttcacactattttagtttagaagttccatgcgtctaggcatgtggctcacgcctatagtcccagcactttaggaggctgaagcagaataattgcttgagctcagcagttggagaacagcctgggcaacatagtgagaccccatttctaaaaaaaaaaaaaaatttaaataaaaaatgagctggaagtggtggcatgggcctatggtcccagctactcagggagctgaggtgggaggatcacttgaccatggagggttgaggctgcagtgagccgtaattgcaccactgcactccagcctgggcaacagagccagaccctgcctcaaaaaaaaaaaaaaaaaaaaaaaaagacgaagaagttctgtgtaggatggtttgactggagagggtgactccagaagttactggaggtggatgagttaagaggcttctgtaggaagcaggtgcaagataaggacaatacagctgggacatgagggacggggaccaagcattatctagccatggaagaacaaagcaaaggtggaagataacagttattaaaaaaaaaaaaaatggtcttccaggtgggtgtggtggctcagccatgtaatcccagtgctctgagaggccaaggcaggaggatcgcttgagcccgggagttccagaccagcctgagcaacacagaaatttggaaatttactcatttctacaaaagattaaaaaattagccgggcatagggacgtatacctatagtcccagctactcgggaggctgaggtgggaggctcccttgaagccaggaggtcgatgctgcagtgagctatgatcacaccactgcactccagcctgagtgacagggtgagaccccatctgtaaaaaacaaacaaaaagtcttctgcattttatgtcttatatacatcctatccacagcactaaataaacccaataaaacatattgataatgtgggaggaaaaaccatggctacagtattagatggaggatcacaccacattgacaggcaaatcagcatcatgattatttcagcatcaaattagcatcaggattaatatgaatccaggtaaaccacttccaatctatgtaaccctgggaaatgacaacctctgtgtgtctatttcctcatctggaaaatggagatattaatattacctccctcatacggttttctgagaagtgaatgggccttataggtattgaaataattatttgccaaaacttatgcaaatatattgaataaatcacaaatgacagtaaatgtactgaaaatgacagggcactgtccactactttagctagcgtggtctgggaagatttcgctgaagagaagaatggaagttgagacctaaagaatgagaagaattagacccagaaagagcagggagggtgggaaaaggtgggagacagcagcacatgctgagaccaacacacaaaaaagctgggcaggtgatgtggggggcggccagggtggctgccctgaagtcagcaaaagggaggcctgaggtgggcagcacagggccaggtcacgtgtgcctggagggcctgcaacaccgatattttattttaagtccgtgaaaagtcctggaatggcccgaaaagcttcaagcaaggaagtgacaagtttattttatttcctttatgagccacaaattatcctctaccttacacaaaaaattatgctgcatctgaaaaacaaatctaggtctatcccaataatgtcttatttctgtggtagttttgcattaggatatagtgataaccaaaaataatccattgaggaccaggcatggtggctcacacctgtaatcccagcactttgggaggctgaggtgggcagatcacttgagggtgggggttcgagactagcctggacaacatggtgaaactcagtctctactaaaaacacaaaaactagccaggcatggtggtgatggcaccggtaatcccagctactcaggaggctgaggcagaactgcttgaacccgggagacgggggttgcagtgagccgagattgggaaagtgcactccagcctgggcaacagagtaagattccatctcaaaaataataataataataatccattgaaatgctgacacctggaacataacaacatttaagtgagtggagtgtggctctagaaaaagatacagagggccaggtgcagtggctcatgcctgtaatcccagtactttgggaggccaaggtgggcggatcacaaggtcaggagttcaagacgagcctggccaacatagagaaaccccgtctcttctaaaaatataagaaattagccaggcatggtagcaggcacctgtaatcccagctactcgggaggctgaggcaggagaatagcttgaacctgagaggcggaggttgcagtgagccgagattgcaccattgcactccagcccagggaacagtgcaagactccgtctaaaaaaaaaaaaaaaaaaaaaaaaacagatacaaagtacactgtgtgctccactgcactgcaaaccagtttctggtctatctattcacctttttcgtggttgtcaaatgtgaagttaattcatcatgaatagacatatattttgttgttgtggatttttttttttcaggtaatggtcatatattttctctgccagtccacatgcctttcctcacactcccttagcctcaattcatatgttcttccaaataactaaaggttgagaattagggaacaagaggtatcgattttaaagctacaaaaacttaggggcactcagtgctaacggcaagctcagctataaatctgacagccattttttggccttccacaaagaactgtccctttttagtcaacaaggggacatgagtacctatcttggtgtgttagtccattttgtgtcactataaagtaatacctgaggctgcgtaatttataagaaaagaggtttaactggctcacagtagactgtataagcatggtgccagcatctgctcagcttctggtgagacctcaggaagcttccaatcataatggaaggcaaagcagaagccagcacatgacatggcaagggcaggagcaaaagaggcaagaaggtgccacattcttttcaacaaccagatctcccatgaactaccagagaactcacgcatcaccaaggggatggcactaaaccattcatgagggatcgctcccatgatccaacctctcccaccaggacccacctccaacattgaggatcacatttccacataacatttggaggggacaaacatccaaaccaaatcacttgggaacagcactgtggggtatattagattatattgtttttcaagcaatggaacacaactccaaaatatgttatggaagttttccaagaagatttgcacaataaaagctacagcaccaggcatgttcactccatgtctgtcccatggcagtggctagatatgatatactttaggtaagagtacgagaacatggagcaactaccttgtctagatgtggaggccaggggggtgagcatcggaggaatcacattcaaactgccaggtgttcctgccacacacagtaacagggccaaaagtcagaaacagacagacatcactatccttaaacacctgatggcctctccaacttccagatgcacacaataaaataccctaattcctgttggccctgttccttcatgagtccaaactctggcctccccaggaccactccctgagctaaaaccaatttggtttcagctaataatatacaatggtaggacaaacccaaaagtatgaactatcacaccatggcatggggtgtacttcttggccatcaagaatttagagatgtggctgggcaccgtggctcatgcatataattccagcactttgagaggctgaggcaggcagatcacttgaggtcaggagttcgaaaccagtctggccaacatggtgaaaccccgtctctactaaaaatacaaaaattagctgggcgtggtggtgagcacctgtaatcccagctactcaggaggctgaggcaggagaatcactcgaacccgggaggcggagtttgcagtaagctgagatcgcaccatagcactcagcctgagcaacagagtgagactccatctcaaaaaaaaaaaagaatttagaggtggctgggcacaatggctcatgcctgtaattccagcactttgggaggccgaggtgggcagattacctgggcccaggagtttgagaccagcctgggcaacatggcaaaacctcatctcaacaaaaaatacaaaaattggccagtcgtggtggttcacccctgtaatcccagcactttgggaggctgaggcgggcagatcacaaggtaaggagatcgagaccatcccggctaacatggtgaaaccccatcccggctaacatggtgaaaccccatctcgactaaaagtacaaaaaattagccaggcatggtggcaggcacctgtggtcccagctactcgggaggctgaggaggcagaagaatggcgtgaacccgggaggcagagcttgcagtgagccgaggttgcgccactgcaccctagcctgggctccatctcaaaaaaaaaaaaaattagccaggtatggtggcgtatgcctgtagtcccagctacttgggaggctgaggcagaaggatggcttgagcccaggaagctgaagctgcaatgagctgagatcacgccactgtactccagcctgggtgacagagggagaccctgtctcaaaaaaaaaataaaaaagaatttagaggtatttactgggtatctcctctattaaaacactgtatttagacgttacaaaaaaggaaaagtaaactccctgcccttgagcaccgtacaccaaatatggatgatactgggtgatacactggctgtcaggctcagtgagaaggaaaactgaatgagaatcagaccaaatgtcaccagattctggtggcgacatgcaagcacagtttcacggttttaaatcctccagctctttctcctccccagagtgtccggtgatgccccaccaacttcgtgcagcacatattcttcctgttaacatcccattctcaaaccacccctctctgctcttcttgctaaaaatatctctcatttgagtaatccttttttcttctcgcactttaccatctgttaagtcaacagagccaggactttagcatcaggaagcccaagtttgagccctactttaaatctttcactcattcagtcaacaatccctgaaagcctattttgctctaggctttgccctagatgtctaacacttaattgtatgggccagtcatttaccctctccaggccctagtttcctccttaaagaaaaaagtaaaaaacattgcctaactaacttcctatgatcacaagcttatcacatagattaaacgatgtaactgagaatgtcttacaaactaaagagagaaacagattttattagtctaccaccaccatcttccaggtgtatagcatacatgttttcaaaatacattcacataaatgacctgattggattctcacaatcaaattattacttaggccaaatggccaaatatgattattatttttcttctacagattaaaaaaaaagaaaaattgaggcaccaagaatggaagtgacttcctgaagcaactaagactagaattcaagtctctcaattctccctccaatgctatttttactactcttaagttgatcatgctaaagaggttttagtgacaagcacaattatttagcctaggtcaaagcaaaccttccattagcaagcacgacttctagccctgtgctctttcctctacaccttgagatacctatcaggcaataatgtgaccgtttcaacagcgagcaaggggaagcaagcccttacccgtcaggaacacgcaaaccatggtatatttgaaattcttctaacagaggtaggcatggagtcacattaatagtaaccaaggcaggtaagaaaagaagactgtcacaccaggtcaattgatgctgagactgtggccaacaatgacaccggcaacaaactaccaagacatagcgatttctggggccacagccacagaggagtcaagctaaaaccctgaggactttgagatccacgaacaggtacagtagtaggaaggatggtgtcaacttcaccatgctcaggaagacctgtggtcaagctccaacggctaactgttaaggttcagtgagaacatttttaaaatttcaccttggtgctcgaactgctcacaaccttaaattgtatgttacctttctaaatagaagccagcccttattcaaaatattctctcaatagtcatattatcaaagaaagagcatgaccagacggatcatttgctattccagctttcctcacagaggcatgtcccaagcaggtataactgactcacgctgccgtaatttgaagcatcaatgccagaagaacttggctgcttctgcttgcgtcaaattccttacttctacacatgatcactcctgaaaattcattagaaggccaaacgttctaatatttgaacaatatatcttcatgttctatatctacctcctgagaactgtgtgtatatatattatttatatatatatatatatatatatctgcataaaatccctaattaggattttttcaggtacctgccaacctcaagtgtgagccccagatcacaccctttccataaggcttagcacccctcctgtgaaacctctgcaggagggaggtctacaggctgggcagctgtcaatctcttaccctccaatgtaggctggaggctgtatagcaggaacaggtaaccttaggtgcctccacctcccatgacctcaacagaaagtgagacccccattaactcagaccaaataaagggctaacactctggatggaaacactgaatgaatgctctgctcaaccactcaaggtttcctgatgctaacgtggctcagggcttgagtctataggacttctcagccctgcaggagggcaggggtacgatacttagtcatcacaactaccctggcaacaggagctagcagatagtgccaccacacagtgacaaaaatcctcggttattgtaatacagtttggtatcagtgtaaactatacaaatgcacagactgtatgaaagttgatcatgtacccggtgaggtacatctatacaggctctgggctgcaaaacccaacttacattacaacacatttcacggccctatgcaatgctgcctgatgctggtgcaaaattcttactgctggctgaagtccacccatctccctaaagtgtcccatggaaagtgactatatggtgggcccacactgaaactactgttatctaagggggacaaataaaaatcaagtctgaactttctgagcagactaccaattcccaacatttttcaacactgttgtcagcacaaataaaaatgaggccaggcacggtggctcacacctgtaatcccagcactttgggaggccaaggcaggtggatcgcttgaggccagaggttcgagtccagactggcctacatggtgaaatcccatttctactaaaaatacaaaaaataaaataaaataaataaataaaaatacaaaaaaaaaaagaaaaaaatgaaccatgtttttctttctcattttaggatattatgaatctctctctcttcattttcaagaccgcagccttatacagcaaggcatatgaaataacagaaactctttggcatttttagtttcctctggatatgcttgctcttgcatttatttgaagacttaaaatttgaatacttatgtgaatagttagtatttcctattcacaagtgctaaagcgacacatattcttagggacctattactcccaagaataaaagatgaatttgggctgggcgcagtggctcacgcctgtaaccccagcagtttgggaggctgaggcgggcggatcacgaggtcaggagatcgagaccatcctggctaacacagtgaaaccccgtctctattaaaaatacaaaaaattagccaggcacggtggcgggcgcctgtagtcccagctactcgagaggctgaggcaggagaatggcgtgaactcgggaggcggagcttgcagtgagccgagatcgcgccgctgcactccagcctgggtgacagagcgagactccgtctcaaaaaaaaaaaaaaaaaagatgaatttgcatcacagcccaagttagcaagcttcccagaacagcccaggtctaactctccatggttccaaaataaaatctcagccctcagcctattaaagccacataaagtcatctaattaatgacacagtgcaacattaggtagcactgtagttattaccatcagtaaatattattggttcttttttttattttttgagatggagccttgatctgtcgcctaggctggagtgcaatggtgcgatctcagctcactgcaacctccactttccgggttcaagcaattctcctgattcagcctccctagtagttgggatcacaggtgcccaccaccatgcccagctaatttttgtatttttagtagagacggggtttcaccatgttggccaggctggtctcaaactcctgacctcaggtgatccacctgcctcggcctcccaaagtgctgggattataggtgtgagccaccgggcccggcccagttcttgttattcatagtagttgtgttctgtaaaatctctgtgaacattgaattagtggatattgaaccagtgttcctaggggaaatgagagtgagattccttccggcttctggtcacatttttgcaaactgatcaatacacaaccttgttttacgtatgtttctgtttaaagacaccttatttaatacctattgttgattcattaatgttgaactcaaggccaacagcaccgtaactcaagcctgaatgaagctcatctaacatgtatattttctccatgaggctcatcacagccttcttggctgaggaacattagacagcattttagcaccatacttacgggccactgtaaatagcaaaatccccaataaaaagcacaaaaatgggcagggtgcagtggctcacacctgtaatcccagcactttgggaggccgaggcaggcagatcacgaggtcaggagttcaagaccagcttggccaacatggtgaagccccgtatctactaaaaatacaaaaattagccaggtgtggtggtgggtgcctgtaatcccagctactcgggaggctgaggcaggagaatcacttgaaaccggaaggtggaagttgcagtgagctgagatcgcgccactgcactccagcctgggcaacaagagtgaaactctgtctcaaaaaaaaaaaaaaaaaagcacaaaaatatataaaaacatgttactaaatagactgcaaaaagcacacttgtttacagcatgagagctcaaacaagaaggcagggtagtgccttgtctgagctctactgggaacatgtgcattgggaggctcaaatttttccccatactgcacatgtccacaaatgtcgaagaaagtgtcagaggcattgatttggggcttacaaataaattttagtgagtagacaaatttataaacatggaaccacgaaaaatgaggatcgactatatctggctattagacctgaggcatgagacacagaaagtacattctacaaagttttctctctttgcaaaagtgctattattctgtatttcaagaaggtataattgttctggttttagcacctcctacattccttttcctaccttggcagtttgtatctgccaaatcttgcatcaagattttgcaatctagttcttatgatactgggtttttttttgcgggggggtggtttatgtggacagatcctaaatgctacagattagcagcattcactttactcttctattaaacacccacccatagcttcattaactttaggtgagttccctgaaagaagcacaaatgagcctcagttaacatacctcgaagaaatttcttaactcacacacacaaaaaactttctctttcaccaggttctcatagctgcaacagctcatctcacacaagcaataagcagacacattggtatgttaaaatcaccacaccaaaacaagaaggcaataccctgccttcttgtttgagctctcatgctgtaaacaactgtgctttttgcagtctatttagtaacatgtttttatatatttttgtgctttttttttttttgagacggagtttcacaatttcagtgacgttaaaattttcccgtgtattttatttttccttcctgagcttacaacttttagtacttttgttaggtcatgttcaaagttacaaaacaacttttattgttaacctactcattattttactaaggcaaattaaaagctgcacagcaaaactctccaagacagatacctagaagagacacgaaataaactctccctttggatttgttttggcaaccaccagagactggtaacagggctgcctccataaggagttaagaggaatttcccactacagattttttttttttttttttttttttggtacagttgggagccgggagtctctctgttgtccaggctggtctggaactcctggcctcaagcgatcctcttatctcagcctcccaaagttctgggattacataggtgaaacaccgcgcccggcccagaacatttaaaagtgaaagtttttacataattatcatgtctgtaagaagtgttaaaatcttcagataaagtcataattttaaatcagttgggggatagcagtaacaactgtgtttatgtagctctttcaaagcttcaaagaatttataaataacacaaaatactttcaaagcacattattctctgtaattcctgaaactctgtgatgtattggaactaatattaccacccttttacaaaggaaaataagatacaaagtttgagtacgagtaacatttctggtcataaatctagtcagtgacactgataggactagaactcaagtctccagaaataataacccagagctgtttttactacaacattcacagttttggaatgtagtccatagttatttatagcagaattatcttcttaattgtattgtgttttggtcaacataaaaattagtttgcattcacttccaaatggaaagcaaaggcaggctgcccagaagtgtgaaaaaacggtggccggggaaattagcctgggattaaaattttgccaaagttaaacaacgaattgaagggtttacatcatttccaccgtgggggagatgacttttcaggccagatgtaacaggaaatacaagaaaaaattcaaaactgtcttgagtgtaagacaagaaacttctgaatcaagtatttctaaatcctttatttaaattgagagcattgggacttagagataataaataacttgtcccaagatcacaccacagggacagctttactgctccgaccccaaaggtctccttaaactgcccactctactccctcccagtcatgcgcagactcttcattagatgcaagcaggaaacaatgaacagtacaagtccgtggactcagcgagtagagaaagagttaaagtttggtatgctaacatggtatgcaaaactgaccttcaaatcctaataggcaaattaattttttttttgtctttgactatttagaggaaacaactgccagactccttctgagtagaggtaggcttgggtatagaacaagatattaaaactccacaaactgggagacagtgcctttcaaagagagggcaaccagctgttgataaaacccagcagaaccgcctccacttccccacacccctaccctcccgcgccaggctgctggttcttattaatcacagagaagggactacaactagcaaacatacagcaccgacgatcaaagtgaaaccgattttttaatcatctaacttaaacagacgaacacatgccagcaacgtacataaatacgaatagccccagcaagcactgtcttcataacctaagacagttaaatgtctcagggtgatgaatcaaaggagacttcaagcaaaacaaaaagcgaacagccctgtgctcttccgcgaggcctgcactgggtgcagggagagtgtgcagtcctgttttggggaccgggcaggaagcacaggaagagtacggtgccccttcccgcagtccacatcacagccctccctgaggccggcggggaccgcggggtgccaggcgcgggcctcctcgcccgccccgagcctccgactcccaggacgtcctccgggagcctaggcgcttccgctcccaccggcgcctcccgagcggcccggcaaggacccgccacctcctccctcccgcagggcatcccggttctgctccgacagcccaccccaaggcccctctcaggccagccctcgcccagcccgggtcccgccccgccgaccgggtcaaccgcactcaccgcccggcggctctgggcgcgcccgcctggggccggcctggccctgcgggggacccaggggcggggacgggacctgggcacgcggggcgcaccccgagggcgcgcagacgcacaggcgggctcgcgcccgagcccccgcacgggcccccgccaaacacgcacacgcacacgcacgcgcggaccgggccggcggacgggagcgcgggagcgcgaggaatccctggaatgaggcaccggccaacctgagccgggctccgccaggccagccaggccacgccctcggtcacgcccctcacggagcaggtgggggctgagccaggtgagccgggagggagataggggcgaggcctcccgcggcagggagaggccgctttccctcccccgccagctgcgcgcccggtgccagctcgcacctcccgggccgatgccggcgcgctggggcagtgaggtttgtcggggcgggcgctcccgagaggcgccagcgggcagggcgagtggacatggcgcacactgctgtggacacggcatctcgcacgcccccgcccccgaggccccgccaggggacacagcgccgtgcaaatgtacaaacacaaacgcacatttcgtgcgcgcccaggtgcccgccgcgctccccacgcgcgcacagtaggtccctgctcccgggggacagcgcacgggacgccgacgttcacagtccaaccagacccgtcccgcggacctgctgcccttcccgccacacacaccccgccaagcgcccggagttcagccgaacctgcggcacccacgccgccctccgcttcccccggctcgcgagcagccggataagggcgcaccacccgcccgcgccggttcgccgtccacacccgctcacccccggaacgcggcgcaccttccgtcccccgcctcccgggccccgtcgccccctctcggcacccgcatgcccgagccgcgctccccgacggccgacggccacgcacctgaagggacaggtcacaccggctgcgggaggggctgctcggcgccactgcgctcagaacggccgcggcggtcccgggcgctccgacgccgctgggtttcctcccattacagcatgttgcactccagcgctgcacttcacactcgcacacgcgcacacgcacacgcgcacaactccaggcgctcggcggcgtccttcccccgcctcgcccggaggaggaagtcctagtaaatcaaaacaggctgggagggagggagatcggagtggaaagagtccccttcagccgctcacacaccagtgtttgctgtgtttggcaaactcctggcgtccacaacccggactgctctgaaatgtgcccggggaggggcagggaggaggaggtaaaacgtttctaattggcgcaggttcttatattacagcagcagggcagacatgtgaccacgaaaagaaaaggcctgtctttaattttttcctgtctttctctggggatttggtggtggggggccgggggatagaggcctgatacccgccccccgccatccccagcaacccttgccctgttgttttcttgtactgccacaattaagaaaacatttgcttaacatatccagcggctaacttcataaaataaatagagactggacttcctctggtttgctttaaaaggcttcatgttgcttgccttctggctgttctcaaacctcagtcattattaggagcccctaccgtaagggctttccctgggagagggctctgctgaaagggaatgataacaatgaaaacaaataccagcttacattcgtgctggaaaaaaaaaatgctttgcagttttcaaactgttttcccatctgttgcctcatctgatcatatcaaggaacagcacggtgtctcactggatcttagcccctgttggatatgcaaagacaggtatgcgtagttccatgtttcagtgagattaaatggtttacctaaagcaggtggaggtgttgcccgaaacttggggccccttgtgaaatgtactctcctccagtccatacagggcctctggagatgggacaacccaacttacaagtcaacctaggaataggtcccctggctttcctgattcctggataaatattcacagattaaagctcggaaggttcccagtcttcccaaaggtactcttacatagactccgttttagtccatcagtagtctcggactaggaaaagagaaatcctgagaaagactgtaaataggagattcatcctgccaaactcagacagggaatgaggaaggaatgaggactgcctgggcagattccaggaaatatggtaagacagaaaaagggttttagattcagacagaatttgaatccaaactccgcctctatttgttataggatttggggcaagttatcaaacctcagttttctcatccgtaaaacagagataatgcttcttcgaagagccggtgtggggttacaggcttcgcagagacgtttaatgaatactcacatcttccttctcttctgacttaaatccagtccaggtgggcaccttatgaacagaggaaaatgaaatgcccagacaacgcaaatgaataatgataacaataatagtgcaactgcatatttataaaaatggcccaaggtttacaaagtgttcccacgtattattatctcatttgatctttatgacaacattgccatttgtttgctgctaaatgatttccattttgggtcagtgcggaggtcctaaagctgcctctttaatttccatcactgcttggagcgaaccttactctgcaaataaatcatggggacagaagaccttttctcatggatgtgaccagtcttcgacctttgcaaggattaatctcactctttgccttacatcagcattagcgtgacttagctctggcaacatctaagcctggtcgttttagtctggctcttttagttgtgcaaaggagagacacactcaagttactgtaagaaaaaggggggttgttgtaaaggtctagggggactggaagtggaacgtggcagacacatagaatattatacagtaacctaaattaaaatgacttacagtgacctcaacaatacagatgcatcttgacaatgttaactgaaaaaattaagtcccaaaagattacatacagcataatactctatttgtaatgttaaaaataaaattaaaaataattttagtggtacatatatctgcaataaaatgatataaaaaataagtcagggccagcctggccaacatggcaaagcccatctctagtaaaaatacaaaaaaaaaatggtcaggcgtggtggctcacacctgtaatcccagcactttgggaggccaaggtgggcgaatcacgaggtcaggagttcaagtccaggctggccaacatggtgaaaccccgtctctactaaaaatacaaaaattagccagatgtggtggcacgctgctataatcccagctactcagcaggctgagtcaggagaattgtttgaacccgggaggctgcagtgagccgagatcatgccattgcagtccagtctgggtgacagagtgagactccgtctcaaaacaaaaaattagctggggatggtggctcacacctgtagtcccagctactcaggaggctgaagcaggagaatcacttgaacccgggaggcagaggttgcagtgagttgagatgacaccactgtactccagcctaggcgacagagctgagtctcaaaaataaaataaaataaaaacaaaataaaataaaaattgaggggatgatgatgccaggattacctgggtgggggtgggggcaggcatgggattggatgggagaaaaccatttggttaaacattgttgtctaggtcctagcttggtaggttcacaggttctctattaaaataactacctaggccaggcgcagtggcttatgcctgtattcccagcactttggtaggccaaggcgggtgcattgctttagctcaggagtttgagaccagcctgggcaacaccgcgaaaccccatctctacaaaaaatccaaaaattagctgggcgtggtggcacatgcctgtaagtcccagctacttgggaggctgacatggtaggatcacctgagtccaggaagttgaggctacagtgatctgtgttgataccactacattccagcctgggtgacagagtgagaccctgtctcaaaaaaaaaaaaaaacaaaaacaaaaaaaaaacttaagtgatggttttacagtagtgtgaatgtacttaatgccatactgaactaaacacttcaaaatggttaaagtggtacattttgtattatgtatattttaccacaagtttaaaaaatgtataaggaacataactgggcaaatcaaaaagaaaacaatactgcttaagtagctaacaaataaaggtaggctgtacatagaccactgatgagaatatatttcaacccaaggattttataaatgcgccagaagtgtattttaaaaacaaaataatcaagggggtgactgagtggaggtagcaaagacacaagattggcccagagttgatcgttgttgaagctgaggatgggtacagaggagggtgttgaggtagcccctcagtgggggatgggggggggtgacactactctatctgctcttacatgtttggattgtttcatagcaaaagattttattttattttattttatttttatatttttatttatttatttatttattttttatttttgagatggagtctcactcttgcccaggctggagtgcagtggcatgatctcggctcactgcaacctccacctcccaggttcaagcgattctcctgcctcagcctcctgagtagctgggatcacaggcatgtgccaccatgcctggctaattttgtatttttagtagagatggggttttaccatgttacccaggctagtctcaaactcctgacctcaggtgatcaacctgcctcgggctcccaaagtgctgggattacaggcatgagccaccgcacctggcctattttttatttttatttttatttttattttgagacagagtctcgctctctcacccaggctggagtgcagtggcataatctcagctcactgcaacctccacctcctgggttcaagcaattctcctgcctcagcctcctgagtagctaaggtagcaggcgcctgccaccacgcccagctaagttttgtatttttagtagagacggggtttcgccatgttgaccaagttggtctcgaactcctgacctcaagtgatcctcagtcacctctgggtgattctccacttctgcctcccaatgtgctgggattacaggcatgagccaccgcacccagccctgtttcatagtaaaacattgtaaaaaggaaaatgaaaaaaaagtgcagagtaggaaggacgcgttgtggctgtgttgtgctctcacccatcgactgcacagcttctcagtttccctttcgctctgtttctttgtgcgtcctccccaatctagttctttctcatctctctgccaaggactttcctcacagctttggctcccttattgctatctctattaccccttttagcttttgcccccataggtaactgactccttccgtatcttcatagttcagattgctcagagaatctgattcttctctttcttcttcctgttcttcttcctcttcctctttttcctcttcttcctcttcctcttacacttcctcctcctgcccctcctccccctcctcttctcctctctcctcttctccttcctcttctcctccctccttgttctcttccctcttttgctccctcctccttctcctcctccttctcctccctctcctccttctccttctcctccccctcctccttctccttttcttcctccctcttctcctccttctccttcttctcctcctcctttttttcttctcctcctcctcctttttttcttctcctcctcctccttttttttcttcttctcctcctcctcttcctcctccttctttttcttcttcctcttcttcttcttcttcttctttcctcctcctcctcctcctcctcctcctccttcttcttcttctcattctgtcacccaggctggagtgaagtggtacaatctcagctcactgcagccttaacctcctaggctcaggtgattctcccacctcagcctcctgagtagctgggactacaggcatataccaccatgcccggctaactttttgtatttttagtagcgatggggtttcagtgagttgcacaggctggtcttgaactcctgggctcaagcaatcatcccacctcagcttcttaaagtgctgggactacaggcgtaagccaccatgcccagcctgactcttccctttccactaatccatagaaatgattgccggctgatctccctggaagccacacagccatgagggtcagtgaagtcaagcacagtccagtgatgagaaacatggtccatgtgggcgtggggtggaatggctttaagatggccacaaccaatgacacgtgtggaaggggctaaggagttcagttcatcagttaacaatttcttaaggctgttcaatgggtgagtgttataaaaaaagttttcccttccacgccaattgccaataagtagtttgtattccagtttgtcctcccatgtcatacttctaaggggcaaataaggggaatatcaacggctgccaatctgaattgctcgtagtacatatagacatctactgttcccctcattgcactaacctggctgtggaaaatgtgtttttctagtctatatccctttgcttatgatgtactttcatgaatctctcctgttttcttctcttcactccgacttgttccacaaaaagcactgaggaatctgaagatgtgggttctagttcacactcctctctaggtgacaaagtgagtcattctatacctctgcatattccaagtcttcccctctgtggggagctgagaccagatcaagttaggcaaacaggtttccttttgagcacctgctctgcctggagccctcttttgagaagggctctggcagcacagttgaggcttagtgacaaagtgtcgagattgattattaatgtatgctatgggcagggaataaaaatgagtgaacctggccgggtgcagtggctcatgcctgtaatcccggcactttgggaggctgaggtgggtggatcacttgaggtcaggagtttgagaccagcctgggccaacatggtgaaaccccgtctctactaaaagtacaaaaattagccaggtattgtggaatgtgcctgtaatcccagctacttgggaggctgaggcaggagaattgcttgaacctgggaggtggagtttgcagtgagttgagatcgcgctgctgcactccagcctggcagcctgggcgactctgtctcaaaaaaaaaaaaaaaaaagaaaaaagaaaagaaaagaatgagtgaagagtgaaccagatgtttgccatttttggtggaggagcgctaaaaatcccatctagtaataacttctttcttttctcatagtgtgagaacaggtgcatttctacttttctgggaaccaaagaactcagtggaaaaaccaaatgatcttatttcagggagagaggaaagaataagaaataatctaaaataataataataactaatgtttgaggagcactcactatgtttcaggcaccactctaagtgctttacaacaagtaccgaattttggcctcataacaattctattgtaaggtaggaactgtaggcatcctccttatgcacacaaagaaactgaaacatgcagacattaaattacttgtccaaggtcttaaagacagtaagaatgcaactagaattaaaccctggtggtccaattccggagtccacctgcttatgcccctcactcctcaggattgcctgcagactaattgcatccagcatcccctgagagcctgctagaaatgcaggcttgcaggacccacccagacctgctgaattggatctgcatttcagcaagcttcccaagtgactcatattcacagtgcactgagaagcaactgcttgcttacagatgttactattattattattatttcagacagggtcttgctctgttgcccagactgtggtgtagtggtgcaatctctgctcactgcagcctccaccgccagggcttcagtgatcctcacacctcagcctcctgaggagctgagactacaagcatgtgccaccacagtaggctaatttttgtatttttttctagagacaaagttttgccacgttgcccaggctggtctcaaacttctggactcaagtgatcctcccgccttggcctcccaaagtgctggattacagacataagccactgtacctggcctatttctttttttttctaatttaattttttttttttttttgagacagagtctagctctgttgcccaggctggagtgcaatggcgcgatctcggctcacagcaacctccgcctcccgggttcaagtgattctcctgcctcagcctcctgagtagctgggattacaggcatgcacctccacacctggctaatttttctgtttttagtagagacaagatttctccatgttggtcaggctggtctcaaactcccaacctcaggtgatccgcccaccttgacctcccaaagcgctgggattacaggcgtgagccaccgtgcccagcccctggcctatttcttataatcacatgtgaatctgcaactatttcaaaaaaaaagaaagtgaaattttatgtaggttttatttttcctgcttttgttgttgaggaaacagagctttgaagaagctaaataagcagcccacttggtaattcaacctatgtattgaggccccacctgctgtgtgtaagacactgctttccgcactgaatttccagcagtgaacaaatcttgccctcgttgagctatcattctagtgggtactcagttcaaacccacatctgggtgccaagtcctctactgctcagaaatatggtcacagattcagagagtagtaaataataaagctacacaaggttcaaatatttgcaaaatgtctgtacaagtatatatgaaagcattaacagtgctaggtacacagtaagcactcaataaaaattaatcctcttcctttctttcttgcagttgcctcagagcctggaaggaagctcatctccactgtgacccaactggatggggtccacgatgggcccattgtgagtagctgtgacctgagcttcatgcccctctggcgattagtcgaagagctgtgattgagggcgatgttccaaggtctggagatggacccttttaaacctgacagggaggccaggcacggtaactcacgcctgaaatcccagcactttgggaggccgaggcgggcggatcacctgaggtcgggagttcgagaccagcctggccaacatagtgaaaccccgtcgccactaaaaatacaaaaatagccaggtgtgatggcaggtgcctgtgatcccagctacttgagaggctgaggcaggagaatcgcttgaacccgggaggcgaaggttgcagtgagccgagatcgcgccattgcactccagcctgggagacaagagcaagactctgtctcaaaaaaaaaaaaaaatacaaaaacttgccagggagtcggtgatgtgtgttcctgtgaatgtcagttcttttcacagcatggttctgagaaagtgcccttaagcaagaccaaatttatggccagaaggattgctcagacccagacatctgagtggcatctaacactattctaaagattgactttgtcctcatgcaaggaattttcctttaaatactataagaacaattcaacatgcaatatattcttgctgtctttcctataaataaatttcactgggctgggacgggaaataaaagcctttttcaacacactaaaaaattgttgcagatgctggattcaaggccagtcagaatttggccgctgctgtcagacagagagtggtttgaatgaggaagcttaccgagaatgaatgtgtgttttcttctgtaggtggaatacaacaacaccccagagtgaaattcttccaactgggattgccctgttaccctgtctttttctttctttctttctttctttcttttctttctttcatttttttttttttttttttttttttttttttttttttatgagacagagtctcactccgttgcccaggctggagtccagtggtgccatctcggctcactgcaacctccacctcctggttcaagcgattctcctgcctcagcctccaaagtagctgggattacaggtgcatgccaccacacccggctaatttttgtatttttagtagagacagagtttcaccatgttgcccaaactggtctcgaactactgactgcaaggaaggaaggaaggaaggagggagggaaggagggaaggaaggagaaaggaaggacaaggttattgggtgccaagtgtgtgcagtgttgaacattctcatttaatgcagtgtgatcctatgaagaagattgtcccattatgcagatgagaaaacaggggctcagagagggtaggacatttgcacgggcagtgcaacactaggatgcaaaccagctggtcctacttctcattgaacaatctttcaataataccactaaattcacccagaaaagacctttggagaatctctaaataaataattgcatttggcagggcgcagtggctcaagcctataatcccagcactttggggcacgatggctcaagtttgtaatcccagcactttgagatgccgatgtgggtggatcatctgagatcaggagttcaagaccagcctgaccaacatggcaaaaccccatctctactaaaaatacaaaaattagccaggtgtggtggcacacacctgtattcccagctgctctggaggctgaggcagagaatagcttgaacctgggaggcaggatgcagtgagccaagatcacaccactgcactccagcctgggcgacagagcaatacttcatctcaaaaaaaaaaaaaaaagaaaaagaaaaaagaaattggctgggcgcggtggctcacgcctgtaatcccaacattttgggaggccaaggcaggtggatcacgaggtcaggagttcaagaccagcctggccagcatagtgaaaccccatctgtactaaaaatacaaaaaattagccgggcgtggcggtgggcgcctgtaatcccagctacttgggaggctgaggcaagagaatcacttgaacctgggaggcggaggttgcagtgagctgagatcacgccattgcactccagcctgggcgacagtgtgagactacatctcaaaaagaaaaagaaaaatgaaaaacaaaaagaaaaaaaattgtatctaccttcttacaaaaccgcttccattctgaagggaaacgtttcctcctggtttcccatcttctctgcaccaccacatggagctggaatttgctggggttcgaatgtgagcaccatgtttaccaaaggatgggaaacccctggcaaaggaaagttgctgatacgttggtattggacggacctgagttcaaacctgggtcctacctgctcaagcctctatttcctcacctatatgatggggatgactcctacttagaaaagtgtgtgtatgcgttagaacagccacataatcagtaaaagtgggtcccaggtcaaagtcatgtgagcccctactgcatgtagtgctgctggattacccagcaagcaggctatgtctgtatttagggcaccgcaatgtacaaaatgatttttgaaataatttgatatatataactaaatgaccagattagtcatcttgggtaaaatcagatcttgtttagactattttatagtttaatatccttctaaattacatatataaggagacatcatcctctttccaggacatagaagcgttaagaactcgaattctgcagggcatagtggcatgtccctgtagtcccagctacttgggaggctgagacaggaggatcatttgagcccaggaggttgaggctgcagtgagccgtgatggtgcccctgcattccagcctgggtgacggagaccctgtctctacaaaaattaataataataataaaagactcaaaaaagtgaagtgccctgctactttagaccaaaaagaaaccctctcctccttaaagcagtaagggaaatgggtttgggtcccaaataaatgagattttagtacagacgggggaaaaggagagcaaggatgtgtttgtttttatttccagggtgggagagaggctttccaaagactagcaagctgatgccccatggcagtggataatgtcatttctagatctttgaggctgctacaaaagccacagtgatgcccagtccagcttccacgtgtctcccctgcctgcccctcctctccccagggactttatgtgaatcctggggttgcactgtgaggggtctcaatctaattagggcatttttttttttttttgagatggagtctcactctgttgctcaggctgaagcacaatctcggctcactgcaaccgctgcctcctgggttcaagcaattctcatgcctcagcctcccaagtagctggtattacaagcatgcatcaccatgccgggctaatttttgtatttttagtggaggcgtggtttcgccatgttgcccagtctggtctcaaactcctgacctcaggtgatcctcctgccttgacctcccaaggtgctgggattacaggtgtgagccaccacacttggcccattagggcaattcttcttccttcctccatgtctccctttcttccttcctctatttcttcgttcatccttttgctctcttctttccctttttccttccttcctccctccctccctgccttcctccctttcttctttctttcctccctccctttttccctctctctctccctccctgccttccttccttctgtctagagcaccatctgtttgccatttacattctagatgttgatgttacaactgtcagtaagacaagcaaggtttcactctcatggagcttctcctctaacacggaggtgttggggaagaggtggggagagagatcattagccaggaaacataatttaagtcatgtaagttaacataaaagagatcattcgaaatagtgaaaaaagaccgtttaaaataatggcaagtgctatgaagaaaataaaacagagcaatgaaatacagggtgacgggttgtgacagcagaatagcatcactccagtagggtgatcaaggagggcctctctgaggaggtgacatttgagctgaggcctgaatgatgacaaggagacagccgtgccacaatctaggggaaaaagatttccaggcagaaagaatagcaagcacaaagactctgggacaggaacacagtcaccatgatggaaggatggaaggaaggcctgggtggctggaccataggaaataggggttggggggacaaattcaagaaaaacctgggaagtggtctggctgtggtaaggagctctgactttattctacatgccaagggaagccacttgagggagtttagggattagggtaatatgatttgagttttttttttgtttgtttgtttgttttgagatggagtcttgctctgtcatctaggctggagtgcagtggtacgatcttggctcactgcaacctccacctcctgggttcaggcatttctcctgccacagcctccggagtagctgggactacaggcgcctgccaccatgcccggctaatttttgtatttttggtataggcagggtttcaccatattggccaggctggtcttgaactcctgacctcaaatgatctgcccaccttggcctcccaaagtgctgggattacagccatgagccaccgcaccaagcctgtgtgagttcttaaaagagctctctgatggctgtgtggagaatagactgtcggtggggcacagatagatgcctgaggccttttacccttctgcagggacctggctgaggcataatgctagtaacagctattcatctggaagggggtgttgcatgactcagcatccaggccttataaggagtttgggggtgtcctgagatttttttttttttgagacggagtctcgctctgtcacccaggctggagtgcagtggcaccatctcggctcactgcaaactctgcctcccgggttcatgccattctcctgcctcagcctcctgagtagctgggactacaggtgcccgccaccacaccgggctcattttttttcgtatttttagtagagacggggtttcaccatgttagccaggatggtctcgatctcctgacctcgtgatgcatccgcctcggcctcctaaagtgctaggattacaggcgtgagccaccacgcccggccaggggggtcctgagatttttaaattttcgtttccaagtccaaacaggtattctggaagaacaaatggctctcctccaagtagtgactcagggacccaagatccttctatcttgtgcctctgccagcctctggggccccagagttcattgcatgaccctctttagccagcaagcagatggagaaagagcatggagaaggcacacgtccttcctcattatgtgggccagcacacaacactttatattccattggtgagaaccagtcacatggcctcactgaatgaagacgggctaggaaatgtagttccggggtgggcagccacttcccatcaccggctctgtgcaaagagaacccgggcctttggtggccagctggtcatctctgtcagcaaaccttctgggaggaatgcgaggcacccgggatgacaagttggcttttggcctgagaagagatgaaaggtgatccttaaccaaaatgggaagctgggggaggagtagaattatccttggggcagaaccaagagttccattttgcacgtagtgtgagctgtctgagagacatctgaaaggagacattgggagggaaactggatatatgaaacgggcacagaggtggcgtccagactgaagacttaaatgtgcattttccccttcacccagtggcttctgatcctgacagctcctcttacagtcatatgggcccttcactgcctttgaccctgagtgcactaattacactggtgtaattcactcctctattagaaagaatgtttgtaattctcttactcactaaatgatagctctattacatgcagctactcattcaacacatagttcattgagtgtctactatgtgctgggcactcatgattagcagggaagaagatctagtctctgcctaatgaagactgcattctagtaggaaaagacagataataaacaaattaaaaagcaaatatggaccgggcacggtggctcacgcctgtaatcccagcactttgagaggccgaggcgggtggatcacaaggtcaggagatcaagaccatgctggctaacacggtgaaaccccgtctctactaaaatacaaaaaaaaaaaaaaaaaaaaattagccaggtgtggtggcgggcgcctgtcgtcccagctattcggggggctgaggcaggagaattgcctgaacccgggaggcggagcttgcagtgagccaaaatcacgccactgcactccagcctgggcaacagagcgagactctgtctcaaaaaaaaaaaaaacaaaaagcaaatgtgactcaggcatggtggctcacacctataatcctagcactttgggaggctgagaagggaggatcacttgagccaggagttcaagaccagctgggcaacaaagtgagaccctgtctctacaaaaaataaaataatcagccaggcatggtggtgcatgcctgtagtcccagctactctggaggctgcagcaggaggatcacttgagcccaggaatttgaggctgcagtgagttacgactgcgccactgcattccagcctgggtgacagagtgagatcttgtctctgaaaaaaattttaaaattcttttaaaaagtaaatatgggctgaggcaggcagatcacttgagctcaggagtttgagaccaacctgggcaacatgacgaaaccccatccctacaaaaagtacaaaaattagccaggtgtggtggcgggcacctatagtcccagctacttgggggtgctgaggcgggaggatcacttgagcttgggaggtggagactgcagtgagctgtgttcatgtcattgcactccagcctgggtaacaaagtgataccttatttcaaaaaggaaacaaaaaagaaagtaaatatgtagtgaatcaggtgccctagagaataatggagaaagtgcctgggaagtcaagggtaggattagtagaaacagaaagacttctataataaggcaacatttgagcaggaacgtgaaggaagttgagggagcaaagcacgtgtatataatgagggaagaatgtgatgtgccaggcgagggcgcagcaggtgcacaggctcagaggtaggggagtacccagcatgtttccaaaccacgcagggcccagcgtggctgcagtggggttggaatgagagattcaaatggggttaggggttgagatcagagaggcagggggtgaatagatcatgcagtagccaaagcaaaggggttttctccaacaccttcatgtaactggagaagggagaaaaacaaacctatttcctcgtgcagaaatctctccaaagagagcaatgtacaatatcaggaacttcctgtgtagtttccaaaatgaaacaccttcaaagtggaggatttgcagcccaaataagaaagggtaaccgtctcataatgtggagtacagaatacaccatctctcctcgtgcagcagttttcttcacagttaattgcagccacatgtgcccatggaaaggaagcatttttagcaagtactatcagagacctgggcaggcgcttcccatccctcatgctcagagcaaaaccaatcatgtgattagctcaggaggatgggaatgtaacagtgctataatgataaatactctgttttctgaatttcaattccaaaatctgagcaagatgccttttattagcttgttttgataaatgtcagaagcagcaggtttaaatcaaggaagacacagtttctcatggtttctgttaggttaccttgggcagttcctcctgataggcccactgtagtgagggtcatgaaacaaaaataccaaggatggcgtctgggtcttttatcgctgctcttgatcacagcggggcctcagcgcaccctgcttcagcaattaccacaaacgtgtgggcaggacttcagagtggctgctcgccagtttatctcatttaatgctggcatccctgggactggtcccattttctgttctatacaagagggtatagagtgaatattggtgtgagtttggctcccaagtgtctggccactcttcctatttaggggaaattcttctgtagacttggtctacagaagccaaagggagctggataatccctccctggggctaagacacaggctcagccaactggatgcacctgcccaggaccagaactcttcaggggatgattcgaaggcttggtggtggcaacatcaagagtccaggaatggcagtgcccaggctgcagtgcagggagagtcaggagtccgtctgcaccagatggctcccggggcagccctggccaccttctctagctcctgaccactttctcggactgattctccagccttcccatctgttcttcagccacccaacacccagccagtgggctccgtttctgcttaccttaaccagagaccactcctgttgtctataacccagaaccctggcttaatcttaagtaatttccagacacccacccccacctgccccccgcattaaagaacagaaattcctgttggcttacattattattattattattattattattattattattattatcattattattttgagacagagtttcactcttgttgcccaggctggagtgcaatggcacgatctcggctcactgcatcctccgcctcccaggttcaagcgattctccttcctcagcctccagagtagctgggattacaggcacccaccaccacgcccagctaattttgtatttttagtagagatggggtttctccatgttggtcaggttggtctcgaactcctgacctcaggtgatccgcccgccttggcctcccaaagtgctgggattacaggtgtgagccaccatgcccagccagcttacattatttttgttatcatgtaactcaaatatgtatatcatcaaactaaatataaactccttagaggcttgtagcttttaagcagctataaaacacaaacacatttgcaggcaaaacacaagcaataccacaaagtcagcaaagttgaaattaacaatattaacttgacatgacagatgatacgattttgtgaaactaaatagctgttccaaatggagatatggagctgactggtcgctgggctcctgtggttttcttattgccatgggccgtttgacaacgtaactcttccacttttcttctccattcaaaccactgtgcacacttcattcacaccacacgttactcacaaatgaaaactgctgctgctcttatgtcatttagctaggacaattaaaattgttccaggtggccccaatgccactgtaaacacaaaggcaaaagcagagcttgaaattagatgaaaaggtcgttcagatgagccacgacttgaacatgtccatttttaaaagaacatcaaaaatattaactttttaaacatctcatagaaaaccataaattcctaagagtacctttgtaaactccagtttcagaaatcatgagaaagtaattaggagcataagccgtggagttaaaaaaagaaaatcctggttttgaatcccaactcaacccctttgctcgtcttagaaccttgaacaagttattgagtatctctgagccttaattttcttacctgtgaaatggaacaataatacccatcttttaggaaagttgtattaaacaagatgatgtgtgtaactggtcaatacatggtgctagttattgttcccgatgtcctattcaactttcaaattggctaatgtttttgcctggttcatacagccagctggccacagagacagcgctggaaccagagctctaagccctggcccttaggagtacccaccgaccttttagggctgtgctcagagggagttgctgtatccgaggggtttatactctgtagacaatcactccattcctgggtaattctgtggatgatcctccccaaaaaatgaatcccactttcccctacttgacaacttctgtccatcccctattcctcatacctgtggttctcacagtggggtttcctgaccagcaggagacatggcagaaacgcaaatgcagattctcaggcctcgtcccacacatactcagtgggtggtggcacccagcagcctgtgtttcagcaaactcccgcttgaccctgatgcaggctgaagtttgagaattactgcattctaggaccaagtccaagttcttagcacagcatccagtgctgcctgttctgggcccagcccaccttttggccccttcacccatcactcctgaaagcaccttccactccagcgacattagactctactctctcatgtctccaacatgacaagcccttttgtgcctctatgctttggtgtatgcagggcagttccctctactgggcatttcttcaaaaggtctccttctctttgaacccttccctgattgcttaaggctgaatctgtggctctccaacttttctgtcaccttctattactaccacagttaccaggctgtactgtcaccagagttacattcttgcctcctcccctagatgataaggtcctcgtgtttgcagcagctagtgaccaatccatatccactctccccttgccctaatcagagaatctggatttcccagctcccttgcagacaggagtagtcaaatgactaagttctgggcaatgagatgtgagcagaagctgatggctccagctcccaggggctggctcttccctcctgcctccttacagtgagtgggcatgctgtggccatcttgcaaccatgcagtgaacttaaggatagaagatgcgttaagggctgggtgcggtggctcactccgataatcccagctactcgggtggccgaggagggagaattgcttggacccgggaggtggaggttgcagtgagccaagataacaccactgcactccagcctgggcaacagaacaagactccatctcaaaaaaaaaaaaaaaaaaaaaaaaaagagacatgttaaggatggagcaaaaagatgagtgaggatactggatattcaggatgttgtatgctcactgcaccaactctggacctttatccccagactacaggttcccagagactcaaataaattcctttcttattggagccattgtttctttcccccggcttccaacaacgcagtctcaggggcaagactgtgttttattcactgcagaatccagtgcctggcacagagcctgactcagagcagatgcttcacgcatgtttttggaaggaaggaaagaatgaatccttccttattatttctgttacaagaggaatcagagctcatgtattgggcctaaaattacttttttggagactctggaaaaccacataaggcaaaaaacaaaacaaaacaaaaaaaacaccccagatcttttacattttattttaaattaaaatgtcatagttttaacttagaccagaataatattatcccaccattggacagaaaataggtgttaaatgaagatgcgtgtcattactgctgaaaatccctcaatagttgctcacagcccttaaaataaagtcccaaatccctagtgttttctggcttctcactgctttttctttctttttttaagtggatataattgcagattcataggtgtttataacagatgatacagaggggtcccatgtatcctctgtatcatttgccccaatggaaacatcttgcacaactctggtgcaacatcacaagcaggatattgccattgacacaatccaccaatcttggttttccccagttttacttgaattcatgtatgtgtatatgcatatttgtgcatgtgtgtgtcctagtccttttgtgctgctatgacaaaataccttagattggtaatttctttttcttttttttttgagacggagttttgctcttgttgcccaggctagagtgcaatggtgtgatcttggctcaccacaacctccgcctcctgggttcaagcctcccgagtagctgggattaggggcgcccgccaccgcgcccggctgatttttgtatttttagtagagacagggttgcaccatgttggccaggctggtctcgaactcctgacctcaggtgatccggctgtcttggccttccaaagtgctgggattacaggcgtgacgactgttcccagcctgaccggtaatttctaaggaacacaaattcatttcttacagttttggaggctgaagtcaaatatcagggctccaggccgggcgtggtggctcacgcctgtaatcccagcactttgggaggctgaggtggatggattacgaggtcaggagttcgagaccagcctggccaacatggtgaaaccccgcctctactaaaaatacaaaaattagccaggcatggtggcgcatgcctgtaatctcagctactcgggaggctgaggcaggagaatagcttgaacctgggaggcagaggttgcagtgagctgagatcacaccattgcactccagccaggtacagaacaagacaccgtctcaaaaaaaaaaaaaaaaaaaaaaatcagggctctggcactggtgtctggtgtgggctactgtttccaagatggtgccctgttgctgcgtccccacacagcagaaggtggaaggacaagagagctgaattcactcctttaagcacgaccacaagggcactgaatcccattcatgaaagtggactcctcatgactcagtcacctcctaaagtccccacctcttaataccatcaccttggggactaagttatccccttatcctcagagaatacatcccaagacccccagaggatgcctgaaaccatggcaatcagaacacatttctcttcatgtcttccacccactaactaagcacttatcattcacagtggccataacttttgcggtttgaagtgcaacagcaaaaccagcacaaatttctttttccttgtccccagtttcatggggagaaaatttgtttttaccatagatcttggcaacttcagcatatgatttttttgttctttctttcttatgttgggaactttcaccttgtcacttaagtggcttctctttggactatcccaattgccagcgtcgctactctggtgcttaaggtcgttattaagtaaaataagggttactggaacacaagcactgggatacctgacagtcaattggataacccagatggctgctagatggctaatgggcagggagcgtctgcagcatggatatgctggacaaagggattattcacgtcctgagcagaacggcacaaaattccatcatgctgctcagaacagcaatcggtttaaagggtatgggattttccatttaatattgaccttggcaaataaataagggggtctaccgtatgcattttagaggaacacacacatttagaccctaagagtgcatgtgtgtatttagttcatgtgtgtaggcccatatatccaattccacagtcaagactcagaacatttccatcaccacaaaaatcccttggggtgttcctttgtaaccccactcccctcccctcccactgtgccctctctcctcatcccagacccctgacgaccaccaatctgttttccattcctaaattgttgccatttcaaaatgttatatgagtggaatcatacagtatgcaaccttataggactggcttctttagcttggcctaattccttgaagattcatcccagttgttacatgcatcagtaggcctttccttttgtcgcggaggaatcctccatgggatggaagaaccacagtttgtttaaccactcacgtgctcacagacaccggcaccatttccacttgctggctgctgcaaatcaagctgctatgaacatttgtgtataagcttttatgtgaacatgcccatcgcttgcttttttttttttttttcctgagacagggtcttgccctgttatgctggagggcagtggcatgatcatagttcactgcagcctttaactcctggactgaagcaatcatcctacctcagtctcctgaatagcggggactacaggtgtgcaccaccacacctggctaattaaaacaattttttttttttggtagagacaggggtctcgccatgttgtccaggctggtctcgaactccaggactcaagcgatcttcctgccttggcctcccaaagtgctgggattgcaggcatgagccactgtgctcagcgacccagtgctttttgaaccccttcctatgactggggagctctctcccttataaatgctgcctactaaagactaaagccagaaaaactcattttcccaacttctcttacatctggggagtgtaggcccccccaaccagacacagccacgcaagattttacgcagaagtgagcagtgtgaggaagcaggcactccaaagaatccatctgaagacaaggatgagagcagaggccaccaaaaacttttggggatcagcaataatggaggtttgcgtgtccatgtcgctgaagccagtgagcttcggggtctataccagcagagtggtggcagtggagtctttgctgaaagtcctgtggggtggtttgggcattgtttctggtcccatggtcctccaaaccccattctctggccctttcagagatgtaaactacctaataatctcttttttttttttttttaagaggaagtctcgctctgttgcccaggctggagtgcagtcgcacaatcttagctcactacaacctctgcctccagggttcaaatgattcttgtgcctcagcctcccaattagctgggattataggcacccaccaccatgccgggtcaatttttgtatttttagcggagacgggtttcaccatgttggccaggctggtctcgaactcctgacatcaagtgatccacctgcctcgacctctcaaagtactgggattacaggcgtgagccaccctgcctggcccctaataatcttctgtaaatttattttctgcttatataagttggagtggattctgttgttcacagctgagagctctaaccagcctccctctgtcgcctcacttctggccactcttaccctcagtgctcccactatacagcagcgctttcagtttcccggaggtaccttagggcatcaggtgcttcccgtggcacagtggagcctcttcacttacctgcctccctcatggaactgcagacctagtatccccagcctctgtcacccttccattgccctcagtatatgctcaatccatgcccaaatgaaccaatcgctcatctttatcattgatgagataagaacaagccagtacaaccatagccagtgctattatggttgccttctcactctgcactacagtcccctcatctataaatggagtaacacttaaaattttttattttttattttttgagatggagtttttgctgtattgcccaggttggagtgcaatggtgtgatctcggctcactgcaacctccgcctcctgggttcaagtgattctcctgcttcagcctctcaagtaactgggattataggtgcccaccaccatgcccagctagtttttgtatttttagtagagatgggatttccccatgttggccaagctggtctcgaactcctgacctcaggtgatccacccatctcggcctcccaaagagctaggattacaggtgtgagccaccatgcccggccaagaataacacttctaagagaagcacggtttaaaagttaatggcagccgggcacagtggctcacacctgtaatccctgcactttgtgggggccaaggctggtggatcacaggatgtcaggagtttgagaccagcctggccaacatggtgaaaccccatttctactaaaaaaagaaaaattagccaggcatggtggcacgcacctgtaaccgcagctactcaggaggttaaggtatgagattcacttaaacccaggaggtggaggttgcagtgagctgagatcctgccactgcactccagcctaggcgacagagcaagactttgtctcagaaaaaaaagaaaagaaaagaaacagaaataaaagggaaacagaaaatagattgggcatggtggctcactcctgtaatcccaacacttcaggaggccaaggcaagaggattccttgagcccagaagttcaagaccagactgagcaacactgcaagacctcatctctacaggtaattttttttttttgagatggagtcttgctctgttgcccaggctggagtatagtggtgcgatctcgactcactgcaacctccacctcccaggttcaagcgattctcccgcctcagccgcctgagtacctgggattacaggtgcccaccaccacactcggttaattttgtatttttagtagagatggggttgcaccatgttggtcaggctggtctccaactcctgaactcaggtgatctgcctgcctcagcctgccaaagtgctgggattacaggcatgagccaccacacccggcctacaaataattttttaaaattagccaggtgtggtggtgcacacctgtagtcccagctacttgggaggctgaggctagaggatcacttgagcacaggaggcctagggtgcagtgagccgtgatcgtgccactgcactccaacttggacaacagagtgagaccttgtctcaaaaaataaatcaataaaaggggaactcaaagagatattagtatatccatgctcatagaagcattattcacaatagccaaaaggtggaagcaaagcaaatgcgcattgataaatgaatggataaaaaaactgatctatgcataccacggaatattattctatcttaaaaaggaagcgaattctgacacatgctacaacatggatgaaccttgaggacattatgctaagtgaaataaactagtcacaaaaaaaccaaatactgtatatttccacatctatgaggtacctagagtagtcaaattcatagagacagaaagtagaatagtggttgccaggagctgtgggaagaggaaatgggaagttatcatttaatgggtacagagtttcagatttgcaagatgaagaaagatctgtggatacatggtggtgatacgggcatagctgtgtgaatgtatttaatgccactgaactgtacactgaaaaatgatcaagatgctaaatttgaagttatacctattttatcagaattttttaaacattagtggtaaactacagttaattaccacttcatattcactgaaatggctaaaagtaaaaaagcctgacaataccaagtgttggcaaagatctgaagaaattggaactctcatataccgtttggcactttttataaacatttaaaaatttaggccgggcgcggtcgctcacgcctgtaatccaagcactttgggaggccgaggcaggtggatcacgaggtcaggagatcgagaccatcctggctaacacagtgaaaccccgtctctactaaaaatacaaaaaaattagtcaggagtggtggtgggcacctgtagtcccagctacgctgaaggctgaggcaggaggagaatggcttgaacccaggaggcggagcttgcagtgagccgagatcgcaccactgcactccagcctgggcgacagagtgagactctctcaaaaaaaaaaaaaaaaaaaatttaaacatgcacttaccatatgacgccagaagtgtacagtgagctgtttacccaagagaaatgtaatgttactagaagacttgtgcacaaatgtcagagcagctttaccaataagagccaaaagctgaaaataagttaaatgtccatcaacagatggacatcaagagataaacaaattggggaatattcctgcaatgaaatactactgagcaataaaagaactactgatatacacaacatgggtgaatcttagaaacattatgctgggggaaaaaaaacatatatcagaggctatatattctaggattgctatttattattaattaatttatttatttatttttaaggcagagtctctctctattgctcatgttggagtgcagtggtacaatcacagctcactgcagcctcaaatgatcctcctgcctcagcctcccgagtagccgggactacaggtgcacatcaccatgcccagctaattttttgtattttttgtagagacagggtctcagtatgttgcctaggctgctctcaaacccctgggctcaaatgatcctcctgcctcgacctcccaatgcactgggattataggcatgagccactatgccagacccatgctgtatgattccatctatatctagaaattctagaaaagacaaatctaatctgtggtgatagatattagatcagtggttacctggaatagggcttaggagagaaagactacaaagacgtgtggtagaactttatttatttataagacggagcctccttctgtcacccaggctggagtgtagtggtgtaatctcggctcactgtagcctctgcttcccaggtcccagcaattctcctgcctcagcctcccgagtagctgggactacaggcgcacgccaccatgcctggctaatttttgtatttttagtagagacggggtttcgccatgttggccagctggtctccaactcctgaactcagatggtccacccaccttggcctcccaacgtgctgggattacaggcatgagccaccatgcccggccagtgtgatggaactttctagactggtagaaataatttatatattgattggtggttacataggcatatgtgattgtcaaaagcctttgaactgcacacttaaaatatatctaaattatacttcaaagatggggcacggtgactcacacctgtaatcccagaacttcaggaggccgaggtgggatgattgcttgagcccaggagttcaagacccctgggcaatatagcgagactccatccctacataaaattccaaaaaactagctgggtatggtggtgtgcgcctgtagtcccagctactcaggaggctgtgggaggactgcctgagcccaggaggttgaggctgcagtgtgctattattgtgccactgtactccagcctaggtgacagaatgagaccctgtctcaaaaaaattaaaaaataaaaaataagttatacttcaataaagttgaaaaatattagtgggacgcagatgagaagtgtctattcaagtctattcaatatttactatttatttatttatttttttttttgagacagggtcttgctctatcccctaggctggggtgcagtggttcaatctcagctcactgcaacctctgcctcctggcctcaagagatcctcccacctcagcctcccgagtagctgggactacaggcgcacaccactacacctggctaatttttgtattttttgtagagataaggtttctccatgttgtccaggctggtctcaaactcctggactcaagcaatccacctgccttagcctcccaaagtgttgggattacaggcgggagccaccacgcccagcctctattcagtatttatgaatcaaacacgagtatctccctcttcagcctcaaagtaattcacatgtctcatattaatattaatattttctgtactcttttatttatttatttatttatttattttttgagatggagtctcgctctatcacccaggctggagtgcagtggcatgatctcggctcactgcagcctctgcctcccaggttcaaacaattctcatgcttcagcctccgagtagctggaactacaggcggctgccaccacgtctggctttttttttgtatttttagtacagtgcagtggtgtaatccctcctacctcaccctcccaagtagccgggaccacaggcatgcaccgccatggctggctaactcttttatttttagtagagacgggggttcaccatgttgcccaggctggtctcaaactcctgacttcaagtgatctgcccccctcagcctcccaaagtgctggaattacaggcgtgagccactgcacctggcctgttttttgtactcttaaatgcagcagtgaaataacagagaaggaaaagggacagaaactgacatttttgagagctttactttctgtaggcgctatcagaggggtcatgtggatggtgtggtggagaatgtgagatttgtatctgtgacaatgagagcctggaggtcccaggggttcctgcttggaactttcccatgtgttatcatttaaccctcaacaccctgggaagtagatttttttttttttttttttgagatggaatctcactctgtcacccagggtggagtgcagtggtgccatcttggctcactgcaacctctgcctcccgggttcaagtgattctcctgcctcagcctctcaaatagctgggattacaggcatgcaccaccacacctggctaatttttgtatttttagtagagatggggttttgctatgttggccaggctggtctcgaactcctgacctcaagtgatctgcccaccttggcctaccaaagtgctgggattacaggcatgagccactgcgccctgctagaaatggatttttattgcactcgtgtttacagttgagcaaagaggctcggatttgttaaattacttccttgtcacatagccagtaagtggtggaaccaggacttgaacctgaaggtgtctctagagtccataatcatttgactacaaaactggacactggaatcttgtattcataatccttgggtcctggccaccaaagcctgtttcctgtgctttacagtgatcagggtccccaggagagccctcgaattctgtgcaacgccaacctacatgagtaagacatggagaagccagtccattgtttagtactagagttgctcaggctctgttaactgacctttctttctgttctctttctttccttatttgtttttatttagttgtgttcaacacaaatcaattccataccatgaagttactatgaatcagagcataaatacacaaacacaacgtgcaatgagaaacagatgcaggacacccagatatgaagcggaagggagggctcattcacacccacagtgcctggagatccgctgggtctgcttgttctcatgttggcttctagggatggcagagctggctttggttagtgagacccactgtggccatttggataccggaaatctctgcatgcatgtgtactcatgtgaaccaaaggcttcatggagtgtcaatttctttttctttcttttttttttttttttgacggagtcttgctctgttgcccaggctggagtgcagtggcacgatctgggctcactgcaagctccacctcccggttcatgttattctcctgcctcagcctcccgagtagctgggactacaggcgcctgccaccacgcccggctaattttttgtatttttagtagagatggggtttcactgtgttagccaggatggtctcgatctcctgacctcgtgatccgcccgcctcggcctcccaaagtgcttggattacaggcgtgagccactgtgcccagtcgggagtgtctgtttctaagaaggtttctctggactggggccattgtgaaagattaactttacagaattgagcctactttaggctcaagactaaccctctacagtaaccctcaggttctaaccattgagggacagggccttactctgttgcccaggctgaagtgcaatggtgtgatcatggctcactgactgtagcctcgaactcctgggcttaagggatcctcctgcctaagcttcttgagtagcagggactacaggcgcataccaccatgtgcggctaatttttacatttttttgtggagatagggcctcactatgttgcccaggatggtcttgaactcctgggctcaagcaattctcctgcctcagcctccccaaactctgggattacaggtgtgagccactgcgcccagcttcctctgaaatattgactgctactgacagatctggagaatactgacatcattctggtggctgaagtcttgtggcttggattcacatcatagctcaataaaatctgtttgagagcctgggtatccacaagctaaagtccagtctatcctcaactcaccaggtgcacaggctgacaacagttttattggtcaggactctttttcattcataaggagactttattgatgcatggaactggcatgttcagagggaacctgctctagatggggctcgctcctgtccccaggcctccatccctctctccttctctctcccttctggagggctttatctggcagtgccaggctggataatgtctagcctggacaataagacatcgtccagggagcacaatgtcaaccacaggtccagggtgcacactctcatcccacaatgcccggaggaagaggaggagtcctttccagaagcttacagatgatactttttttttttttttttttggacacagagtctcactctattgcccaggctggagcacagtggcgtgatctcaaatcactgcaacctctgcctcccgggttcaagcaattctcctgcctcagcctcctgagtagctgggattacaggcatgtgccaccacacctggctaatttttgtattttcagtagagatggggtttcaccatgttggccagtctggtctcgaactcccgacctcaagtgatctgcccgcctcggccccccaaagagctgggattacaggcatgaaccaccgcgcctggccaagacttttccttatgagcccaagcagcatcttcttggacatccttagctctgatttggccccacgaatagcactgagccaaatgcctcgggaggtaaccctgttgtgtccagtcagagcctgccgtgctggggccaggcctaccgaacctcatggttgagaatgatagagaatgaatctctctgaggacaaccagggcactgttggcagaagacagggccaaccctggagggccaccagcgtatttcctccagagctgcatcctccttaccttgaactgaccggcttacccccgaagtgtgtcaagtctggacactgctcaggccttagattgtgaaactccctgccgcacttgccactgctgatccttcttgaaattctctactttaatggttcttgaccctgtctgtcttctgactacgttaatgtggagaattttgcacttatcgatagccagggggttcagatatgctgggtatgagactggggtaggggtcaggtgtctgtttgcttacagagagtcctgggtgaccttgatgcaagtagctccaactaggaaccactaggcttctgtggcatcaccctctcctggtccactgtgcaggtatttactgagtatgtgagggacactcaggcaggtgctaagcatcagagatgaacaaaacaaggtcattgtgtgtccggagttggttccttccggtgggtttgtggtctccctgacttcaagaatgaagctgcggaccttcgcggcgagtgttacagctcctaaaggtggtgtgtccggagtttcttccttccagtgggttcgtggtcttgctgacttcaagaatgaagccatggacctcggcggtgagtgttacagctctcaaaggtgacaggggcccaaagagtgagcagcagcaagatttattgtgaagagcaaaagaacaaagcttccacagcatggaaggggacccgagtgggttgctgctgctggtggggggtggccagcttttattcctttatttgtccctgcccacatcctgctgattggtccattttacagaatgctgattggtccattttacaaacctctagctagccactgagcgctgattggtgcgttttacaatcctagctacagagtgctgattagggcattttacaatcctcttgtaagacagaaaagttctccaagtccccactcgacccaggaagtccagctggcttcacctctcaattgttcttacaaagcttttttttttttttttttttttttttttttgagacagggtcttgctctctatcacccaggcttgagtgcagctgtgcagtcatagctcactgcagcctccaattgctgggctcaagcgatcctcctgcctgacccttcagagtaactgggactacaggtgctataggcgcatgccaccatggctggttaatttttattttttaattttttgtagagatagggtcttgctatgttgcccaggctggtcttgaactcctgggctctagcgatcgtcctgccttagcctcccaaactgctgaaattgtaggtgttagccaccacgcctggcccatatgaagcttatatcacagtgggggatgttgagagagacaactaaatgagtacatgtccgaaggggttcagatagtgctgtgaactatcaggatgaagctgataggaggaatgaagaaagtcaatcaggatgaagtgatgggggaatggagagctgtcttagataggatgctcagcactggctgccctggccagcgcagtggctcatacctgcaatcccagcactttgggagtcagaggcgggaggatcacttgagcccaggagttcaagaccagcctgggcaacatggtgagacccccatctctactaaaaatacaaaaaaagaaaaaatagtggggcatagtggtgtggcttgtagtcccagctacttgggaggctgaggtgggaagatcatttgagcctgggaggcaaaggatgcagtgagccaagaatgcaccactgcaccccagcctgagtgacatagcaagactgtatccaaaaaatataggccaggtgcagtggctcacgcctgtaatctcagcactttgggaggccgaggcatgtggatcacaaggtcaggagattgagaccatcctggctaacatggtgaaaccctatctctactaaaaataaaaaaaaataaaaaataaaaaaaagtgggcgtggtggcgggcgcctgtagtcccagctactcgggaggctgagacaggagaatggcgtggagacaggaggcagagcttgcagtgagctgaggttgcgccactgcactccagcctgggcgacagagcaagactccgtctcaaaaaaaaaaataaaataaactggctgtcttgggaggtgatgaactccaggaggagcagacctaaaacaggagtgtgcttggtgcaccccaataaagaaggagattgtatgtctgacgtgaagaaggaagggcaaggggcgaggaggccgatgacaagataaagggggcatggccagatcccactgagtgcttcaggatgcagcaaggagaccagattcattctcagtgcaaggggcggcctcgtgttctcctcacatccctgtccatctctgttttttgccagctgctgtttctccacctgctcctaagtgctgctgttctcccagctcctctcattctacctgcaggaatcttggttactttcacgtggtaaccgagaccccctgctcctcggctatggactcaggtatcaaacactggcaggaccctctgtctgtatatcctgtgggttcctcaaaacttgcgcaaagccacctagcatcatctgtcaatctcctccactccctgtgtctccagctcagctaccaacatgacccactacccaggcatctaatctagaaacccaagtgtcactatgacttcccccactcctcaccaactactgccaatgcattaccaattctttttaaaaattttttcttcttattatttttttaggcagggtctcgctctataacccaggctggagtgcagtggtgcaatcatggcttactgcagcctcgacctcctggattaaagtgattctcccacctcagcctctcgagtagctggtgcagtccatcacgtctggctgatttttaaaaaaattttttatagagaaggggtctctttatgttgcccaggttggttttgaactcctgggcttaaaagatcctcctgccttgaactcccaaaaatgctgggattacaaacatgagccactacatccaaccactaactctttttaacctctgaaacatttctcagatctctttttttttttttttttttttttgagacagagtcttgctctgtcacccacactggagcgcactggcatgatcttctgcctccctggctcaagtgattctcctgcctcagcctgccgagtaagtgggatcacaggcatgagccaccatgcccggctaattttctgtatttttagtagagacagggtttcaccatgttggccaggctggtctcgaactcctgacctcaggtgatccacctgcctcggcctcccaaagtgctgggattacaggtgtgagtcactgcacctggcctcagatctctcttctcctcactgtccttccttctaggattctgaactgatgaccacagctcttccctagggagctgcagcaacccctaatcagagcccctgccctcaaatacaggcctcccctcctcccctcatcctgctcttcctgactttggcagacagcaaagcctggataacaaagggtggactcagggtagaagcagagaggagactcggcctaacacacacaggctttctgcatccaaggccactatctgggctttgagaaaagtctgtgacgtgtagatgtctctcccagccccgcaggcactggcatgggaccctctcacaagggacccaggaagaaactaagaagagtcggcttgtggggaaggaatgcggaaggactaaagggattgaggaaggcctgttgcaggagagaaagaagaggtgatcaagaccagaggctttgtttctgagggaccgtgggaggatggtacggtgcttcaagcactggagtcagagaacacattcctgttaaggagctggggaaaggaattcacacgaggagaactgctgccgagcactctgaacattctgtgtattgtcgggcggggatgtccagcttgaacctaaaaagaagggcatttcacgtgcccttggtcatgacccacatgcaccggatggccagcactaaggctgcctggcaatgtatccctccctccaagctcacagtgccacaaaggccctatcaggctctgctctcctcccacacacctctccagcctcaccctctcaccacttccagaaccggctcttacactccttagggtccacacatgccatgctgttctcactgtctgcaataatttcaccccatgaagcacttcctccctgagctttctcctgcctgctgtctgttcgtcccctgactgatgttagcatggacgagtattatataatggggggcaaaacatgtttggacatcacacagtcttggattagaattccagctttcctctacactccctggattagaattccagctttcctctgcactccctttaagaccttagcaatcactgtgtccatcttaccatgagtgaaatggagtttattccaggactatttgcggctcaaatgacttttataaagtgctctgcacatagtaggtgctcaataaatgttagcgccccttctctgcccttgaggcactcgattaatgcttttcaattctagagtcactgaacagctaccatttgttggaagctaccaagtgtctggtggcactgtcttttctccttttccatgaccactcttacttatcctgagtgtgattctcttttctcatgcattggaactgatgtgctggccatgcagaggaataggcaggacctgtcatttactgagggtccactctgtgcctgaccttcacgagctgttttccagacagtctctcagttaatattcacaatgactctttgaggtttgttgtattaatcactatcttatatatgagcaaattgagactctgggaagttaaataaccttgctgagattaaacagccaggactgatagagccaagacagaaatccggtcttctggggccaggtgtggtggctcatgcctgtaatctcagcactttgggaggccgaggcgggcagatcacatgaggtagggagttcgagaccagcctgaccaacatggagaaaccccgtctctactaaacatacaaaattagctgggcgtggtggcacatgcctgtaatcccagttacttgggaggctgaggcaggggaattgcttgaacctgggaggcagaggttgcggtgagctgagattgcgccactgcactccagcctgggcaacaagagcgaaattccgtctcaaaaaaaaaaaaaagaaaaaagaaatccagtcttccagattccaaagcccatgatctttcaaatggactccatttcctgtcagaaaggatactatatactagtaacagtaataaaaatagttaacacttagtgattacatatggactgggaactattctagctgagtacttgtgttaatttaattaacctttgcaaacatcccatgccatcgttcctattattatcccattgtacagataactgaggcacagaggggttaaacaacctgcccaggtcactgagctgaatctgtgtgcatagaaattacagtcttcattctattttcttctttcaaggagcacggtaagatccatgttcacatgagagagaataagtggaaacattttacacactgtaaatgcttgagagatgttcgctgttatgttgaaagttgagtgaggggaaattctgagtggactcagagtttgaaaaccagggaacaagagcactgttctgctggaactctcttgagagtccaggggcggccgtctccccaggaaagcagggtagcgtccaagaatcatgcagcggtcagaggaactcagagactgacatttgtcacctgtccctggagagctgcagaaccataagccttacaaagatgattagcagcccacgagaccacagacagctcttccaaccagcaaacagagttggcactcttgcacaatcccctgggagtgcgtcaccatgatgtcaccttgtttattcctcgcgtggatatcaggccccaatgggcctgatgaactgccggccacagacagcaaaatgacaacgctttgtaacttatcctggtgctttaatctttgctctgattctgcgatttagaagcaattctgtgtcacttcccctcaatcactggccatgtcaccataccagtgcagggtgacaatcattcatacagaaaacatgtaggcgctgagagcctctttctaatcctgctccctgagcagctgctcaggaggcgttggtgaatgagaatagcagggtcctcgttgtttaggaactgagtccagcagggtagggggacactgaagaaaccaagttgtactgggagtttttataaaggagagttacagagagccatggaagtgtaagtctggggcccccattcagtcttgggagggcagaggatgcctcccagaggaactgatgtctaagctgagccagcaggttaagtaggagtcagtcgggtgaaagaaggaaagaacagcacaagtggtggcagcagacagcaaagccccaggaatggagacgatcccagttgtctggaggttagagagcccgcatctcaaggtaagcgggagctgctaggacacaatgctggaggccgaagtgagctgttaagagttctgggacattttgtttttgaagggcaatggagacattccaggattttaagttgggagcaacatgatccgatctgtggggtttttgttttgtattgttttgttttgtttttttgagacggagtctcgctctgttgcccaggttggagtgcagtggcatgatcttggctcactgcaatttccacctcccaggttcaagcgattctcctgcctcagcctcctgagtagctgggattacatgcacgtgccaccatgcccagctaatttttgtatttttagtagagacagggtttcaccatgttggtcaggctgtctcaaattcctgacctcaggtgatccacccaccttggcctcccaaagtgctgggattaccggcgtgagccactgcacccggccagatctgtgtatttttagtttttaattctgtttttgtttttgagatggaatcttgctgtgttgcccaggctagagtgcagtggtactatctcagctcactgcaacccccgcctcccaggttcaagtgattctcccgcctcagcctcctgagtaactgggattacagccatgcaccaccacgcccggctaatttttgtatttttagtagagatggagtttcgccatgctggccaggctggtcttgaactcctgacctcgtgatccacctgccttggcctcccaaagtgctgggattataggcgtgagccaccttgcccagcctgagaaatataatttaccctcatattctttaatctcccccaaatcccattaattattgctcttaaataaagagcattatatgctttaatctccccaaatcccattaattatttaagagcaataatttttaagagcaattattaatgggatttggggagattaaagaatataatggtaaaaaatcaattatttttcatctttgtcattaaaaaaaaatttgtcagagacccacctgcatttgctcggcactactcagccccactccgtactgctcacgtggagggagtgatcgccatctaagagcttagcgggtgatcaacggcacatccattctttcaggaaacacctagatgcttaatagcaagcatctctcatgtgccaggcactgcacgaggccctgtaaacgagatgccaactctgcttggaagtggtacggtggaaggggcattgggccaggcagacatgggctcaagctcctaccccagcacctcctgagggaactccttcaaccttttaggaccctgatgtcctcacgtgtaacactggaataaagacacctggcttccacagcccatgtatggatgaatgggaatgcatacggaaagcaattgctcaaatacataccaattcctcccaccctaccccagttcctccaccttccaggttttagcgtctagatgaaaaccaaattctataaatcaggtttaagaaaacattcctggctgggcatggtggctcacgcctgtaattctagcactttgggaggctgaggtgggcaaatcacttgacgtcaggagtccgagactagcctggccaacatggtgaaactccatctctactaaaaatatgaaaattagctgggcgtggtggcacgcgcctgtaatcccagctatttgggaggctgaggcaggagaatcgcttgaacccaggaggcagaggttgcagtgagccgagatcgcgccattgcactccagcctgggggacaagaatgaaactccatctcaaaaaaaaagaaaaaagaagaagaagaagaagaaaacgttcctgagtagaaaacccacacaaagtggacagacctaataataatatttccaaaacacatctattgtcatcattctggatgggcaagtagctgccctctcagtaagctttttttcattaaggaaatatattagcttacctgtcaaacttgttttcttccctgtaatgcaagcaattgcctatgcttcccaaagcctggaggccaatctactgccactgctgacattgacccagtggccagttagactaatattcaggacttgccaaggtgctctctccctggaggcctcctaaaatccttaaagcactaactcaacatttcctcttgagctctcttcaagccgaatcagttgcttcattttcacttcttcataaacttagttgttaataattttatttttcatttttagcatttgcttgtttttctaatttcttccaattttaattttctaatgtcttgaccttttataaaagaaatggatgatgatgctattccttcttctattccttagaggactgtaagtacaattttttgttttgttttgttttgttttgttttgttttttgagatagggtcttgctctgttgcccaggctggagtgcagtggtgcaatcttggctcactgcaacctccacctcccgggcttaagcgagtctcatgcctcagcctcctgagaagctgggactataggggcccgccaccatgcctggctagtttttgtatttttagtagggatggggtttcaccatgttggccaggctggtctcaaactcctggcctcaagtgatccacccgctttggcctcccaaagtgctgggattacaggtgtgaaccaccacgctcgaccaagtcatcttaaaatcattttcaggcccaggcgtggtggctcacatctgtaatcccagcactttgggaggccgaggtgggcagatcatgaggtcaggagatcgagaccatcctggctaacacggtgaaaccccgtctctactaaaaagatacaaaaaattagccaggcatggtggcaggcacctgtagtcccagctactcaggaggctgaggcaggagaatggcgtgaacctgggaggcagagcttgcagtgagccgagatcgggccactgcactccagcttgggtgacagcaagactctgtctcaaaaaaaaaaaaaaaatcatcttcaggttgttgttttattttcattttatctggaatgaattcatctcttcttgattgctgattttgtttggttctgtatcttattatcattgattttcctaatagactttgggatcttggtttgctcagtcttcttgagggcacttttcccctcttgatcaccccagtttctctgctgcgctccatctttcctgtctagcagtttctagttgcctctatccagcccctgtggctcctagtccagaattgagtctctgttggtgcctgggctctccactcatagaggagaaatgcagttccaggccccaggtcactgcaaagactggcccaagtcttggtttctctgtctcctgagaaacataagtttataagccatagttccaaatagctgccgactgcagatttcttagcttcctttcacagatgcaaggtatctgtgcacgtgcatgtgcgtatttgaataaagagatccttccccttccgggcgcggtggctcacacctgtaatcccagcactttgggaggccgaggcgggtggatcacccgaggtcaggagttcaagaccagcctgaccaacgtggtgaaatcctgtctctactaaaaatacaaaaattagccgtgcgtggtggcgagcacctgtaatcccagctgcttgggaggctgaggcaggggaatcacttgaacccagaaggtggaggttgcagtgagccaagatcacgccatcgcactccagcctgggcaacagagcaagactctgtctcaaaaaaaaaaaaaaaaaaaagaaagaaagaaaagaaaaaaagaaaaaagagacccttccccaggccccaatttgaagcaggaggtctgagttgttcttgcactttgcttggtgcccttgccatgcctgtcactgagtaaaaacccaattcctgcttctccacccagagccctgcaggcccattcgtcactcatgtatctttgttactactccgcagaaatatgtattacatgtttcagtatagtgggtttttttctgtctctttttatcatttatctgtcatttcatatatttggaaaagggaaaccctcaaagcacaatcttaagaaattatcttgacctgagctcccacactgcctgcacagacctttgctagtgcacttattacatggaattataactgtctacgttgctgacaccaccagttccccaaagccatgggtcaagtggcagagccaggatttgaacctcagtctactgacaccaagtcctcttacctagtatgccgatggatgaatacaaccatttacatcttcccatcctgagtgccttgcacaagctctggcataaaatatgtgctccgttattatttgttgagtaacttaaacttagactcccactactgtcttctagatttatcataattctcttgtccttttattccccctaaatctagcacagtatccctctatttagacatgcaaggtaagtgaactcctgactctctccctatcctggccttcctgtgcccataacaaacatcatggccaaagaactctctctctcatgggtctgaccctttctgtacaaccttttaagaaattgattgtgaggctgggtacgttggctcactcctgtaatcccagcactttgggaggccaaggcaggtggatcacctgaggtcaggagtttgagaccagcctggccaacatggtgaaaacccgtctcttctaaaaatacaaaaaattatctgggcagtggcggatgcctggggatgcaggggaatcacttgaacccagaaggcggaggttgcagtaagccaagatggcaccactgcactctagccggggcaacaagagtgaaactctgtctcaaaaaaaataaataaataaaagaaattgattttgataatcatttgccctcccagtgtagacacagatttctcttttgccaattggaaatcctaaagccatcctccacctttttgttttttgagacagggtctacctgtcacccatgctgcagtgcagtggcctgatcatggctcactgcagccttgaccccttgggctcaagtgatcctcttgcctcagcctactgtgtggctggtactacaggcatgtgccaccatgcccagttgatttttaaaaatttatttgtagagatgaggtcttactattttgcccaggctggtcttgaacttgtgggctcaagtgatcctcccaccttggcctcccaaagtgctgggattacaggtgtgagccaccacacccagtcccttaaagcttttgaaagaaaaaagatgggaaaattgataaattaagctcatgcagtggtctgaaggagtgatctggaattttacttctctctttaattttggcctaaaatgtgaaaaacaaacacatctcgacatgatgcaattctgtgatcctgggttatctataagcagcctccaactaagaaaatcacagtaatttcccataatattactttatatttcaataacactcatctcaatttcataccaaaccaattacgtgggtgttatcgttcatgttttaacacatgatgaaactgaagcagagaggttaagtgtcctggcgaaagtcacacaatggataaagggcggagcctgtacccaaacccagatctttctttccatttctaagccttctgttgcctaatacatcactgctatacactaattttcaagtgccagaaacatgaaggtgaccttcagagtcatttttgtttcaatattatctttgaataatatataaagcattcgcaggtcactgacttttatttattacgtgtctctctgtctttttgttttgttacttttttggttgttgttgagacagtgtctaactctgtcgcccaggttggggtgaagtggcgtgatctcagctcactgaaggctctacctcccaggctcaagcgatcctcccacctcagcctcccgagtagcttggactacaggtgcacgccaccatgcccggctaattttttgtagagacagggtctcactatgttgcctaggctggttttgaagtcctgggctcaagtgatcctcctgcttcagcctcccaaagtgctgggattacaggtgtgagccatggcgcccagacctgttctattcaattttataggtgcaatgctgtgtgtgcctggggtcagggactgctttgcgttcccagtggcttgtgaagtgccagaccctgacacatgtttgcagagctcccagacctttatcccgaaggccacacaacctgaaggcccagggtaaccagcaaggtcccaatgtcccataatcttattcttttttttttttttttttttttttgagacagagtcttgctctgtctcccaggctggagttcagtggcgcgatctcggctcactgcaagctccgcctcccacgttcacgccattctcctgcctcagcctcctgagcagctgggactacaggtgcccgccaccacgcctggctaattttttgtatttttagtagagacggggtttcaccgtgttagccaggatggtctcgatctcctgaccttgtgatccgcctgcctcggtctcccaaagtgctgggatcacaggcttgagccactgcacccggcccatcttactctttttcaataaagacagctaggtaaatgtataaccaaatttgatgtaagttatatacaaaccttttcatatataaaataccacaagtcacacatatttttacaattgtttttgaaactcagttttcctgctttagccagaaaaatagtcattgtcagatcatgatttgtataaaatgctttgtgactcagtcaaccaccagctgacctcacgatacaaaccttagttggcctcacctttcctgtggttttcccacactgtttttatagctttcatttaaaataacattcagttgagcctccaatgaaaccaagcctttgttctcttcctcctgtttttcctccaaaagaactgacaatataagccttttctctggctctggttaagtacaaacccatgatcaagtggacccagggacttgctgggttccaggctcttactaccaccaccctgacagtcaaccacaaatacccgtcaccgccatcctcggtatttcatcatcacaatcgccaccactagctgagctcttactatgaggcaggtacttactaagctttcacatgaatcaggaattcatgtaattttaattgccacaacaacactatggagtaaatactacgatgttcttttaatatataatgaaattgagactcaaataagttaagaaaacttctccaaagccacagagctacaagcgtaaagacaggattcaacaccaggtcatttccagtttcaaatcctcaggataccccatattaaatatgcagtctgtacatataacacacacatacagacatatgagaattgagttgcagctatttgatataagaccatattttagagacatttaaacatttgttaatgatgttattatgattatcttttcaccttctggagtcaaaattttttttttttttttgagatggagtctcattctgtcgcccaggctggagtgcagtggtgtgatctcagctcactgcaagctctgcctcccaggttcaagtgagtctcctgcttcagtctcccgagtagctgggattacagatgtgtaccaccacacccggctaatttttctatttttagtagagactgggtttcgccatgttagccaggctggtctcgaacccctggcctcatgtgatccacccacctcagcctttaaagtgctgggattacaggcgtgagcaaccacacccagcctggagtcaataaagatttttgctccatccaaaactttggtcagctcttgagagactcatagagtccacagggtaggcctaggattcctgacaaataaaacaatgccatcaaatagcaacatcatttaaagaatacagacatgctactgctgggaaattctttttttgttgttggttttttttgagacagggtctaactatgttacacaggctggagtgcggagtgaggaccacggctcactacagcctcaacctcccaggctcaggtgatcctcccacctcagactcccaggtagctggggctacaggcatgcaccaccatgctcggtgaattttctgtatttttttgtagagacgggggtcttgctatgttgcccaggctggtcttgaacttctggactcaatcaatcagcccatcttggcctcccaaagtgctgggaatacaggtgtgagccaccgtgcctagctgggaaattcttattttggaaggagaagtacagaaaagaggtagagtatgtttttatttttatttatttattttattttattattttcttcaggccagatgtttttatttttattttttgagacagagtttcactctgtcactcaggctggagtgttgtgggtacaaatggctcactgcagccttgacttcctgggctcaagcaattctcctgcctcagcctcccttgtagctgggaccaggtgtgtgcactactacatctggcaaattttttttacttttttgtagagatgagggtctcactttgttgcccaggctggtctcaaactcctggcctgaggggacctttctgcctcgacctcctaaagtgtgggattacaggtgtgagccactgcatccgacctagagtatgtttttaaattaagttttttattttgagatcgctgtagattcacatgcagttgtaataaatgatagagagtgatcccatgtaacctttacccagttccccccactggtaacattttgcaatgctgtaatattaatacaatttcccaaccaggatattgatagattcactgattttagctcttatttgatgtagagtatctttttttctttgggacagagtctcactatgtcacccaggctggagtgcagtggcatgatctcagctcactgcaacctccgccctctgggttcaagcaattctcgtgcctcagcctcccgagtagctggcactacaggcgcgtgccaccatgcctggctaaattttgtgtttttagtagagacggggtttcaccatattggccaggctggtctcgaactcctgacttcaagtgatctgcccgcctcagcctcccaaagtgctgggattacaggcgtgagtcaccaggtccagccagggtacttatcttgtttctactatcttgctattatgaatgatgttgtgatgttgctatggatattgctgcatgagtttttgtgtggatgcatgttttcatttctcttggatatatacctagaggcagaattcttgggtcatatgatgactacacggaactatcaaactgttttctgtagtagctttactatgttacattcccaccagcaatgtacgagggttccacttactccccatccttgtcaacacgttgtgcatttttttttttttttttgagacagagtcttgctcttttgcccaggctggagtgcagtggtgcaatctaagctcactgcaacctccgcctcccgggttcaagcaattctcctgcctcagccacctcagtgcctgggattacaggcatgtgccaccacacctggctaatttttgaattttagtagagatggggtttcaccatgttgctcaggctggcctcgaactcctgacctcgtgatccgcccgcctcggcctcccaaagtgctgggattacagacgtgagccaccgcgcctggccatctgtccttttgattatagattttgattatagatcaaaatgggtgcaaatcaaagccacagtaagacaccacttcacacctgtgggggtgaataggtgtgaagtggcatcttactgtggcttttatttgcactgccctgatggctaatgatattgaacatctttttatgtgcttattggccatttgcatatcttctttggatgtaggtggaaaacttttttgttttttttttgagatggggtttcattctgtagcctggctggagtgtagtggcgtgacctcaggtcactgcaacctctgcctccagggctcaagcaatcctctcacctctgtctcctgagtagctgggactacatgcatgtgccagcatactaggctaattttaaaaattatttgtagagatggggtctccctatattgcccaggctggtctcaaactcctgggttcaagtaatcctcctgccttagcctcccaaagtgtttggattacaggcgtgagccactgcacccagccaaatcctttttaaagtcgtgaatgtacttgatgacaaagtgaatgtgacaaggtatttcccacaattttatgttagaatagaagaaaaacatatgttttatgcaattacatactcactcattcattttccaagtacctatgctattccagacaccaggaaatttagagaagaaggagaaaccagttagttgattatcagaaatggcatagacaagatgttatagtcctcctggcacttttgtaacagtctgcttctgacttatccaaatggttcagctccattcctggcagggcagaaaaggcaatgagacaaggttcctgatttccagtagctcactatctagtgggagagagaaacacataaatatgtcattgcggtcgcagatggttatctacccacagagcttaggagcacagtggagggagcaggtaattctgctaggcacctagaaggggtgcaggaggaggtgacatttgaatttggtcttaagagatattcagacatttgacagatggtgaaaggagaaggacattctagccatcaggcacggcctggtcaagggcatggctgaggatgtgagagccgagggtgagcagagacagagggtggaggggaggagtggaagggagtggaccacgtcatgaagagcctcactaaggagcatccatctacaaacagtctcactctgcgcccaggctggagtgctgtggtgtgatcttggctcactgcaacctctaacctgacgggttcaagcgattctcctgcgtcagcctcctgagtagctgggattacaggtgtgtgccaccacgcacagctaatttttgtatttttagtaaagatggggtttcaccatgttggccagacttgtcttgaactcctaacctcaaataatccatctgccttggcctcccaagagattttttttttttttttttttgtaagcagaagagtggtgtggttcgatctgaggtttaagagatcactcacaggcagccagttggatggattaaggggtcagcaggccaaagggtaaatatttgtggccttgtggaccacacagtctttgttacaacttctcaactctgctgctgtagtgtgaaagcagccataagacaatacatttaagtatttcatttaagaaagaacccggctgtgttctaatgcacatgtatttacaaagccaggaggtatggatctgtcctgaggaccatcatttaccaactcctatattagactaaggtgggaatgaaggcaaggagaccactgactatgtggaaattctctcatgaatggagaaaatcagaatggggtgagggaagtgcaaccaaggcagagggtatctttcagcctcaagaggagtcaggtcctctacctcggctgtgctggaaagtgtgactacacgcctcacggcccagctcgcatttcctacaaagcaggcagaacacctagttatgcaaagagcatcactcacagccactgcagccacctgggaggtgtggagcttctatctgtgacaagcctgccaaggaactcacaggcccaggcaaggagaagcctagaaaacaaggtagaaagtcttggaaaagcctcatttggtctgcgatgtaagaaaacttgattccagttaattgaggtaaagaagaattggttcaatctcatagaatccacaggggagatgtgtgattggtcccgcactctaagagctggagagcgagaagcaggtgcctcttctggcctctgtggggctgcacagactctgtctccgtctcttctgcaaaattggcatccatgtgtggactgctcatcagtcagtgtggggtggagacacagagaaagttcaggagtacataagtggccccataaaaacatgcaccctaccactaccctggagggcagctgaccgggggtgtctggtccagcctctctaacaactcctgcacctctctgtccaagccccttccccttgctgggcaaaataaagggggcagtttcgatcactggctctcaactgggatttctcccaaagtagtaatgaggtcgacttgcaagcatttttggctttcaaaaagccatttaaaatgctctgcttgctgatgaaagctgtggtttctttgctctcggctacgattctgtcaactcagggtagtaacactgctgagcgcgtgctgatctgaagctctgattggctgctggtgacataataggaaggtcaggaacgattggctggcagctgagaccggctgagccacataccaggaaggtgtgttgggcgtgaacagagcacgcttagagcaggaacagaagtacgagcgacagcctaccaacatccttcaagcatgggggcaggggaggcatgtgttaaataacagagtcttcaagatagtgaaaactatgcatcatttctagggtcctcttttgtgtagctcctgtctccccctagtcccaggtgtctctccccagagggctggagggccaggccaggctcgcagacaagtgggtacatgtacccccttcactcccagttccctcctctctgcccagacctgctctccgcagccctgaggcgggcagctggtccacccttctcccctgcagttctctctaggcttaggacccaggtccctccctgctctaggtggtctggatgtcagcatctcaagctgcggcctcaggcagcaacaggcacgccctttatgaattatctgagcagagcacagccacagtgggaggaataaaaataacaagaaacacaaaaggtgcctccttgaacaggaagagacactagggatgggggactggctcacctggtgagtcaccctgcgttccctcttcttggctggctatcaaaagagaagagaacacaggcaataacctgtggcctccagggacgggctgggcgttttagaaaggccctgggtttgcagaagagaacagcacgcatggtggggaggctgctggaggttgggattctacgtctggctcatggcaaacctgatggatgactttgggctcttttcagagtctctgttgcctcatttgtttgtttgtttttgagacggattatttatttatttgagtcggagttttgctttttgtcgcccaggctggagtacagtggccagatttgtttgtttgtttttgagatggattatttatttttgagacagagtttagctctttgttgcccaggctggagtgcagtggtgtgatctctgctcactgcaacctccgcctcccaggttcaagcgattctcctgtctcagcctcccaagtagctgggattacaggcgcccgccaccacgcccggctaatttttgtatttttagtagagatggggtttcaccatgtttgccaggctggtatcaaactcctgacctcaggtgatcgacccacctcggcctcccaaagtgttgggattacaggcgtgagccaccacgcccggcctgtttatttatttttaattttaaaaagtttatatatttaaggggtacaggttcatttttcttacatgtgtatattgtgtagtggtgtacccatcatcacccaaatagtgaacactttacccaacaggtgattttccaaccctcaccccctcccactttttatagtctccagtgtctgtttttctttttctttttttctttttttttgagacagaatcgctctctgttgcctaggctggagtgcagttgtgcaatctcagctcactgtaaactccacctcccaggttcatgccattctcctgcctcagcctccggactagctgggactacaggcgcctgccaccacagctggctaatttttttttttttttttgtagttttagtagagacgggctttcaccgtgttagccaggatggtcttcatctcctgacctcgtgatccgccctccttggcctcccaaagtgctgggatggcaggcgtgagccaccgtgcccagcccagtgtctgtttttctactctgtgtgttcatatgtacctattgtttagctgtcacaagtgacaacaagcggtatctagctgtttcggagttatttcacttaggataatggcctccagttccatgttgctgcaaaagacgtgatttcattcttttttttaatggctgagtatatccatggtgtgtgtatgtatcacattttctttatctgatccttggttgatggacagtatatctgtgcgattgtgaacagtgctgtcataaacacatgagtgcatgcatcttttccctttgggtagatacccagtaaagggattggagtctaatggtagttctatttttagttctttgagaaatccccataatgtttttcatagagttgtcctcctttattaagcctcctattcagggtgaggcactgtgccaggggctctacatacattgatgctaatcttgagaatcatcctgccaagtagggtctttatcgtctccatcttaaagaacaggaggcagttccgagagattaagtaacttgcctgctgtcacacggtatactcttgattcaaactcaggtctttctttctctctctttttttggaatggagtctagctctgttgcccaggttggagtgcagtggtgcgatcacagctcactgcaaccttcgcctcccgggttcaagcaattctcctgcctcatcctcccgagtagctgggattacaggcacacaccaccatgtccagctaatttttatatttttagtagagttggggtttcaccatatgggacaggctggtctcaaactcctaacctcaagtgattcacctgcctcagcttcccaaagtgctgggattacaggtgtgagccaccatccctggccaaacccaggtctttttgattccaaagcccccaagtattgcttattttatttttgatttgcttaaaaaaaaaaaagctagttaatgactagcactttgtgaactatttttctcccaacatttttaattttttataaaatttaaaaaatagaggtggggtctcgctattttggccaggttggtcttgaactcctggcctcaaacagtcctcttgccttggcttccaaaagtgctaggattacaggcgtgagccaccgtgcccagccccaccccgacattttcttttttgactaccatcaagtactagcagaacatccagacctgttggcaaacaagcagtaatggagacacttggaaacttgaccctgagtagctcaacagcttgttttctccatgagccagtaggcttctagctgtgatttcattaatttataacagtatgcacatttaattaagcagaatgtttcttgcccaacctagatgctaaatccatcaatgtgttatgagctaaattgtggttcatacaatgagaaatagaaaagtcagtgttgggggccgggtgcggtggctcagcctgtaatcccagcactttgggaagctgaggtgggtggatcacctgaggtcaggagttcaagaccagcctggccaacatggcgaaacctcgtctctactaaaaatacaaaaattagcagggcatggtggtgcatgcctgtaatcccagttacttgggaggctgaggcaggagaatcacttgaaccaggaaggagaggttgcagtgagccaagatcatgccactgtactccagcctgggagacagagcaagactccatctcaaaaaaaccaaaacaaaacaaacaaaaaagaaaagtcagtgtttcatcatcttatgcaaaggaagctataatttccaggtgttctgccacctacaacaggtttgagcactcttgttctccgactctatgaacgcacactttgtgcacaggaaaacttcctggataaaacagagccaggcagagctctctcaccactgtagaatgaaagttgctttctttgcttccttgggaatcagaaaggtgctctgcccctttctatgtgcacctggaaagttctccatcaaaccaagctgacagggaggctctccagcctgccaataagagcagtgactgagtgccagagggactgttacctagatggccaggctagcccaagatggacagaagagggagcactttccgtaaaacagccacatgtcacaggccccagctgccgcctgcaatcctctggctcccaagactgcccagggccctactgctctccctgggaggtttgtcttggtctatttgggttgctataacaaaatgccatagactgggtggcttataaacaacagaaatgtatttctcagtctgcaggctgggaagtctgagatcaaggcactggcagattcagtgtctagtgagggctttctggttcatagatggccacttctcattgcaacttcacatagaagaaggaagaaaggatctccctgggtcttgctgatagtgtcctaatctgccctcatgacctaataaattcccaaatcctcatctcctaataccatcacattgaaagcattttttttttttttttgagacggagtctcgctttgttacccaggctggagtgcagtggtgcgatctcggcttaccgcaatctccgccccccaggttcaagtgattctcctgccctcagcctcctgagtagctgggattacaggcggctgccaccgtgcccggctaatttttgtatttttagtagagatggcgtttcaccatcttggccaggctggtttgaactcctgacctcgtgatccaccccctcagcctcccaaagtgctgggattacaggcatgagccaccgcgcctggccttttttaatattaagatgcattatttttgtacaggcattttttttggttgggggacacacaaattcagaccatagcaaggttccagccataagccagaatactttccttataactatcactgaaggaccactggtcagcccccacgtttgccaggctttggggccctagtccccctcttcctgtcacattccccgccaccaccctggtgatttccgaaacccatgtgaacaacttacccctcgactgtctttcaggacagtgttacaatttcaccaaggtggccaggacctagccattctgcagtcacatctccaacacttgtgtgcaaatggttatagatttagagagatgtgtgtgctgagtttaaataaagtcacgccactgcactggtggaagtaacttaactcagattcagatacaatcattatttactgagctcctaatgtgagctgggtgtgaccatctctgtcgtcccatttgatcctaaagataaccgtttgcgcagcattattcacaatagccaagatatggaaacaacctaagcgtctgttgacagatgaacagatcaagaaaacgtggggtgtgtttatgtatatatacagccatgcactgcatgcctgccgatgtttcagtgatggaccacagacacaacagtggtcccataagattataataccgtattcttactgaactgtttcttttttaagagaagtgtgtgtgtgtgagatcagaatttcagtgtccccatgaactcagtacattctacacttgtcttccagctgtttgcaaatgtttttcttttggttggtaatttttttagaaatagatcttttattttttaattaattaatttttttttttttttgagatggagtctcgctctgttgcccaggctagagtgcagtggcctgatcttggctcactgcaagctccgcctcccaggttcatgccattctcctgcctcagcctcccgagtagctgggactacaggcgcccgccaccacgcccggctaattttttgtattttttttttagtagagatggggtttcaccgtgttagccaggatggtcttgatctcctgacctcatgatccgcccacctcggcctcccaaagtgttgggattataggtgtgagccaccgcgcccggccatttaaaattttttttttagagacagggtctcactatgttgctcaggctggctttgaattcatgaactgaagcaatccttctgcttcggcctccaaagtaggtgggactacagatgtggaccactgtgcctgacttactgtacctttgctatgtgtggacatgtctagacacacagtgctcaccactgtgttaacaactgcctcggtattcagcacagtaacctgctgtacaggtttgtggcctcggagcagtaggccatcccatgtagcctaggtgtgcagtggtaggttaagccatctaggtttctgtaagtgcactctatgacgctcacgagaagaaaattgcctgacaacgcatttctcagagggtatccctgtcattaagtgacacgtgactgcagagacagaccatccaggacttaacgctctttcgactttacgatgaattgatggggacgcagccccattgtaagtcaaggagcctgcaaacattatttcaccataaaagagaaagaaatcttgccatttgcgacaacatggatgaaacattggagacattatgcttagtaaaataaaccagatatggaaagacaaagactgtgtgatctcacttctgtgtggaatctgaaagcatcaaactcataaacacagtagaatcgtagttcctaggggtcaggtggaatgggaagattttggtgaaagggtacaaacattcagttctggggatctaatctacagcatggtgactacatttaaaaataatgtattgtctacttgaaatttgctaagagagtagctcctaagtgttctcaccacacagacaaaaatggtaactatgtgaggatatgggtatgctaattaacttgattgtggtgatcttttcacaatgtatacatacatcaaatcatgagattgtataccttaaatacatataattttttttgtcaactatacttcaataaagccggaagaggaaaaaaaggtaactatttgagcttttgcttcttcaattagagctaatccagctaaaaaatggtttgggcatttccaaaaaggagttgaggtactactaaatgacgtcaggattaatgttttaaccaaccaagaagcagcattgaaaaactttctaacagcttcgttgagatataatttacataccatagaattcagccatttaaagtgtacagttcagcaggccgggtgcggtggctcacgcctgtaatcccaacactttgggaggcctaggcaggtggatcatttgcgatccagagttcgagaccagcctggccaacatggtgaaactctgtctctactaaaaatacaaaaattagccgggtgtggcagtgtgcacctataatcccagctactcgggaggctgaggcaggagaatctcttgaacccgggaggcggaggctgaagtgagccaagatcctgccactgcactccagcctgggtgagggaacgagattccatctcaaaaaagaaaaaaagtgtaaattcagcgtttttatttatagagttgtaccgccatcatacagttttagaacattcccattaacctaaaaagaaaacttcccaattcttagcttcactcctaagcccccaagccccccattacccacttccggccctcagcagccacaaatctacatcgtgtctcggtacatctggctatcctggcatttcatgtaagtgacatcgtatagtatgtggtcttttgtgtgaggcttcttccatttggcatcatgttttcgaggctcatccgtgtcacagtctgcatcagtatttcactcttttttattgtcggttaacagtccactgtccagtttttgtgtggacatatattttcatttctcttgggtatatatacctgggagtagaatttctcggttatatgagaactctatgtttttttttcctttttagagacagggtctcgttctgtcacccaggctggagtgcagtggtgcgatcacagctcacagcaaacctccaactcctaggcttgtcaagtgatcctcctgcttcagcctctcaagtagctggggctacaggcacacataccaaacccagataatttttaaattttttgtagacacagggtcttgctatgttgcccagtctcaaactcctgggctcaagcaatggcccacctctgtgtcccaggaactctatatttaaccacttgaggaactgacagtttcctcagcaactgccccacttcacattcccattagcagcccatgagggctccactgtcttcatgtctctgtaaaataacacttgtttttttgtcctttttttttctcctttaatctcttttttggaaaaaacatcggaaaatgactatgtgtcttttttatttagccttcctagtgggtgtgaggtggtatctcattgtgatttgatttgcatttccctgatgatgagtgatgttgggcaccttctcgtgtttattggccattcgtgtatcttttttggagaagtgtgtgttcagatcctttgcctatttttaataaggttgtctttatatcctagttataagtgccttatcagatacatgatttacaaatatttttttcccattctttaggttagcctttcacttttttgagggcgtctgctatgctacggtttggatgtctgtcccctccaaagctaatattgaaatttgatgcccaacgttggaaatggggcctaataggaggtgtctgggtcatgggggcaggtccctaatgaatagattaatgccctccctcagtggtgagttctcactctgttagttcctgtgagagcaggttgttcaaaagagcctggcacccgccttttccagctctctctcgggccatgtgacctctacacactggttcccccttccccatctgccatgagtgggggcagcgtgaggccctcaccagatgcagatgcccaatcttgaactttccagccatcagaatcacgagccaaataaacctttactctttacaaattaaagggagagcaaagagaggaggaggaaggtgccaggctccttttaattgccaggtcgtgcaggaactatgagtgagaactcactcactccagtgagaatggtaaagcttttcatgagagagccagccccatgaccaacacacctcttaccaggccctacctccaacaccgaggatccaagttcaacatgagatttggaggggacaaatgtccgaactatacagtcaccatccatctcctgtgacttgacccctgctctccgtgttttcctctgattacctctcaggtttgtttgttctcttcatgctggtgtttgttgttggtgtgcccttgggtctcttctctgtgctccacagacttcctgagagatcctcattcactcccatggtgtctttagtcactatctattagctgccaattctcacatttccatttccagctccagacctggggagccaactgtttactcaacatcttccacagacattccaaacgcagcatgttcagacccgaattcatcaccatcctcctgctatccccaaatgtgcccctcctcctggatccccagctgaggaaacaggcataccattctcccatttgtgccagcgggagccttggcaagcccttctccatagtcagtcatcaagttgtactgagtccacttcctagacatcacttcaatctgtcccttttggtccattctcagtgatcctgccctggaccaccatcatctctcaactagatgactacagtcttcccctttctagtctattctccatagtgcagccacactgatgtttgtaaaatgcaaatccacttttgacactctctagctcaaaaatccctggctggctctccattgctctggggataacaatgaacagactaacaagaattttaagacctttcacgatctggcctcagtcatttctccagcctcactcctgcacagtatatgtctggcactttattcatcttgaactaactttagttccctcaacacactgtgttctcttcatttagggcttttgaatatccatagtcctatgtctggaatactcttccttctcctctggctaacccctacttgttcttaaagtaacaggctagacatcacttgctgcttccctccagattgggagaacaccaagtgactgaaagacagtttagtcaagaggttaagagggagggctttggaacctgatggcccggtttgggatccaggctgtcctgttagttttctgtgcctctgtttcctcatgcatgtaatagggaataataagagtccctgttacataaggctgtggtgagcattaaatgaataaatatatagaaagtgcttagaagagtgcctggcacactgtaatggctcaaccagtttcctgtcactttgaggtatctctatagttaccctatagttacccctgtaattaagtacttatcagagaaatctaattcacaatttactttacttttctgcattgtaagatccttagaattgggacaactctccagggctccagctcttggtatgcagagggcatttatgaaatttttgttaaatacttgactaaatcagtgaatgaatgaacttctgttcacagcattgatcgcttctcaccttgcattatgagagtggattttatcttctctatttgatttactgtaagcttactgaggcagcaccacagcaccgtcatcttggcatatcccatctcctccaaccaacactgtctgggaacattttattcctgtaattcaactaataccagttgaactaaagcctcctctctgggaataggctttagacttctcctgcttttcatctgccacgtcctgtcatcctcttctatgtaacccactgcaacctggaattttagggactttcttgtatctgtagctcagttgtcacagtaggacagttatacaaggagttggggacagtgaaattcaagttagttaggagctaaatttaggcagatgtcctgtagtgtttggaaagaatgatgggctcagacgttttgttcttcctgatctcagaaatgctactgaagctcttagccctgttataatttacccatatgtggggtgggtagaacagcatgctgaagcgaaaggggaattaagtaaaaagtaagagacccggtcaggtgcggtggctcacacctgtaatcccagcactttgggaggccaaggctggtggatcacctgaggtcaggagttcgagagcagcctggccaacatggcaaaaccccatctctactaaaaatacgaaaattagccaagcatggtggtgcacatctggaatcccagctactcaggaggctgaggcaggagaattgcttgaacctgggaggtggaggttgcagtgagccaagatcataccactacactccagcctgggtgaaaaagtgggactccatctcaaaataataataataataataataataataataataataataataatcatacaaataagagacccaggtttttgtcccagtcgtcaacaaattggtgtgaccttggaagtcacagcctgcctgggttgactcatcccaccggtaaggtgaaggagtttagatggttttaaagtttcctattaattctgacatatcatgcatgtatcatctcttctgatgtagctcattctaggaaggaattttctatggtcccacttcatctcagaaggaacagagaaaagaaagcaatgacaccaggtgtctttagctgcatggccagtgatggctgaaaataatcatgggtcagatcacctggatacacatggagagaacaacccacatcctgcaggcatggcccaaagatggggtgtgatactggaaagtgaatgcatttttgagtcatacagaactgaattcaaatcccactatggggctaaattaacctctgtaatcctgttttcttggttgtaaaatttttttttaaaagttgggctgggtgtggtggctcacacctgtagtcctagcactttaagaggccaaggtggatggatcacttgagcccagcagctcaagaccagcctaggcaacatggtgaaaccccatctctactaaaaacacaaaaaattagccaggggtggtggtgcgtgcccatagtctcagttacttgggaggctaaggtggtaggatggcctgagcccaggaagtcagggctgcagtaagctgagattgtgccactgcactccggcctgggtgacagaatgagaccctgtctcaaaaaaaaaaaaaaagaaaaaaaaagtgggatcgtatctacgttgtaggagtaggataaggattaagtgaggctgtttacatattacaccttctataaatcataggccttccataaaccttaggttttctccatttttatacagtccactagttcaaagtactttcacagataatggcctgtgcctgtgaaactttagtttactcctttattcctccccacacggttggagtttggggcatggacttttctgtgggttcaagctcagtgattttttggtgggacagagtgcctgagtcaatgagcatcttcccttagtttaatgcagcatctgatgagattcagtcctgtgtgtcctctagctcactgagggtgttttggagggacagggctcaggtaggactcggagcttgaagactcactgcaatggagagcctcaaaggagtaaggatccatgattcagctggagctgcagaccaggcctctggccatggagaccctcagcaaccccgagggtgctggacaagagcttctcctttctaaagtcctgcttatgtgccagagtataaaagaatctcactgagcacatggctattttgactctcatttagtggtcacttgggctctgatattattgcacttgtgggcagaggcagctcatcagtgctgggctttcttgcatttatggttttgccaaaccactttttctccagtctcccagggactgatgattttggagcacagtgaggaaactcaaccatcagctccaaacatcacctggctcaaccataaagcccaacatcacctggctaatctgtgacagagctgacctggggggtatgactagccacctttggtcaccaaatccaaagcttttcccaggatcacctggctaataaagggaaatgttaggattagaagccagggcaagcaacctggagacaagctctcttttaggaatcagacttttcatgagatagttgtaaattctgaaacaatgttttaaggaattctagccacaaatcaggacgatgtcatttgccaggcattgtttagtcaactggttatttttataagtgagtataagattcataactccaagagacagttatcaaatggcagtaatatcaacaataacagctaccatttactgggcacctattgtgtgcttagctgtggtatggtatagagaaacacctgcccatgatgactgagcagtggttaagagcactgagaccggattcagaccattcaaacatgggcttgaatcctggttctaccacttaactagctgtgtgactttaggcaaggtacttaacctctttgagcctgtttcctgatttgtaaagttagaataatagtatttgccttattgggttgtgtaaggatgaatgagttaatacaagaaacattgctccaaatagtaagcactatcaaattctcattactcaaaatgtaaaatgtggaaccatgttcaataaaagttaaagactacaacaacccgatacagacaggacccatagggacagctcttcagtagtggagatttgggccccaaccaggtaaggaactctgcccaaatgaagtacaggctgagggcaacaggaacacagaatgagtaaagggagaaagatgccgtatctactgtgatatcataacctttttaaaaaatgatgtggtggctcatgcctgtaattctggcactttgggaggccgaggagggcagatcacttgagttcaggagtttgagaccagctggtcaacatggtgaaaccctgtctctactaacaatacaaaaaattagccaggtgtggtggtgtgagcctgtaatcccagctactcaggaggctgaggtgggagaatcacttgaacctgggaggtggaggttgcagtgagccaagatcgtgccactgcactccagcctgggcaacagagcaagactctgtctcaaaaaacaaaagaaaccaaaaccaaaacaaaaaaggtaggcatatttccttccttgcgtggtaatgtgtatatacatactcacggacaggcacacgggtatttttaaccccttcccttcaactattttctatgaggagagtgggtggtggttaatgttataggctagtttctaaattatacaaaatccagttgggattctaattaaaagaggcattaacatcacccacagatgaatacagtaactgtagggactttgtttactctttcctgccagaaaagtgagaacacttcttttcttttctttttttttttttttttttttgaggaggaggagtctcgctctgtcccccagggtggagtgcagtggcgcaatcgtggctcactgcaacttccgcctcccgggttcaagtgattctccagcctcagcctcccaagtagttgggactacaggtgcccgccaccacccctggctaatttgagagcattttcttttgtacaaaggatagctgcatcacgttgggtggaaacaggaagctgctgctggtgtatggaaatttacatatgattgaagggtggatctggatgctcagtcaccacagggaggtgtttctctggtgagctcggccattcctctgtactccactctctactgctgggtaggagcctgcaaactatgttgcccaggtttctcaccagctggctttctattaggttttgctgattggagaccgtggtgtcagatcagaagataggaggaagagaagttcctgggtttgtctgcaactgcagcagcagttactggtggttgtcaagtggcatctggtttttgtttttgttttgttttgttttgagatggagtcttgctctgtcaccaggctggagtgcagtggcgcaatcttggctcactgcaacctccacctcctgggttcaagtgattctcctgcctcagcctcctgagtagatgggactacaggcaccccctaccatgcccagctaagttttgtatttttagtagagatggggtttcaccatgttggccaggatggtcttgatctcttgacctcgtcatccacctacctcggcctcccaaaatgctgggattacaggtgtgagccaccgtgcccagcctgtttttttcagtcagagtctcgctctctcacccaggctggcgtgcagtgccacgatctccgctcactgcagccttgacctcccggggttcaggtgattctgccatctctgcctcccaagtagctgggaccacgggtgcgcaccactgctcccagctaattttttgtttactttttgtagagatgaggtctcactatgttgtccaggcgggcctcaaactcctgagctcaagcaatccacccaccttggcctcccaaagtgctgggattacaggtgttagccaccgtgcctggcccaagtggcatctgggcagtggtggtgactctggcagctctagcagtggcaaaggcataagttttcagaggacttgtatacagtatctaatgctgtgtacaagtcttctgaactgtgtacaagtcttctgaaaacttaatgactttttaatctttttgagagacagagtctcgctctggtgcccaggctggtgtgggcttgtaggttccaatacagggctgttagcagcttcctgatgtgcagcttctctgcacgtaatccttccttctccagggtaccccttcttttttgtttgccagccctcccaacatctttgtaacaaaatccctacattaagttccatttatttatttatttatttatttaattttattattattattattattattattattattttttgagatggaatcttgctctgtcacttaggccggagtacagtggcacgatcttggctcatcgcaacctccacctcccaggttcaagcaattctcctgcctcagcctcctgagtagctgggattacaggcatgagccaccacacctggctaatttttgtatttttagtagagatggggtttcaccatgttggccaggctggtttcgaactcctgacctcgtgatccacccgcctcagcctcccaaagtgctgggattacaggcgtgagccactgcagccagccccttctatttattatacttagggttgttttcatttttcttgactagattgtgcagtggcacaatcacagctcactgcagcctcaaccttctaggctcaagcaatcctcccacctcaacctcctgagtagctggggctacaggtgtgtgctaccatattttaaagtttttgtagagatgcggaagtctcactatgttgcctgggctggtcttgaactcctgggctcaagcgattttcccacctcagcctcccaaagtgctgggattacacgtgtgagccaccacgcctggacaactcaatgactttaaatgacaatgatcattttcttattctccctcacacttccaaaagctgactgggcttggctaggcaggtcctgcttgggctctcttgttctgtcatagtcacagtggctggggctggagttaaaggcttgctcactcacttgtctggcaattgatgttggacatcagccagaacacctccatgtggcctctcccagtggcttgggcaccctcacaacatggcggctgggttgcaagccaagtgtcctgagagagagccggaaggaagctgtgtcaccttttaggacctagccttggaagtcatagagcatctcatctgttatattctacctgttagaagcaagtcactaaggcccaccgacattcaaggagggaaaatgaatgctactgctaggaggtgggccaaagaatttgtgaacatattttgaaaccgctacagggagcatctccagcaacacagcagcaggtgtgggcttgtaagttccagtccagggatgttagcagcgtcctgatgtgcagattctctccacgtcatcccttcttcctcctccaggataccccttcttttttgtttcccagcctcccaacatctttctaacaaattccctatattaaattccttctatttgatatacttagggttgtttccattttcttgactagactgactaatatatgagggactatcccatgccatctaaactcaccatctgaactggatagcagagatactatcatgatgtgccaagaaccacgttaggtaatttacgttatgtcatttaattctaacaccaaacctgacagatgggtataagaatacctacatcatagatatagaaactaaggttcagaagggttaagcaacttgaccaaggacacagctggaaagagttgagaaccaactccaggtgtgacaccaaagtacatttatttcttgagccttctggaatgagaagagctacttactcccgaagagttccacttccctcagagaaagtcttacctctcctccttatatggctttttgatgaatcaccttagattgaggaaaaggaagaatacatctggggcagtggaacacaaagacacaagtattcatcatttgtgaaaactgcaggctgtgtgagaaaaggcactacactggagtctggaagccagggttcaagccccagcaatgttactcacatatgttgggaccccaggcagtcacttcctctccagaggcctgattccatagctggagagtgaccctggtgttctgtgctccaatgagtatctagttggtaaagtatctactttgggaatataaaaagctctatcagatacagaggacagaagttaaagtaaaataaagccagattatagtgggtcttgaataggctgaggaaaaattcgtatcgtataagcagtggagaatccattttgtcgcccaggctggaatacagcggcacaatcacagatcactgcagccttgacctcctgggctcaagtggtcctccctcccaagtggctgggaccacaggcatgtgccaccacatctagctaatttgaaaaaaactttttgtagtgatgtgctctcgctatgttgcccaagctgctcttgaattcctgggctcaagcaactctccagcctcagccttccaaagtgctgggattccaagcatgagccaccatgcccagtctattttgggttctgaaggaaaaaacttacacaaataaacaaaaaggcttatagaagaaaataataggccaagcacagtggctcacgcctgtaatcccagcactttgggaggccgaggtgggtggatcacctgaggtcaggagttcaagaccagcctggccaacatgatgaaaccctgtttctactaaaaatagaaaaaattagctgggcgtggtggcagccacctgtaatcccagctactcgggacgctgaagcaggagaattgcttgaacccaggaggtggaggttgcagtgagccaagatcatgccactgcattccagcctgggcaacaagggcgaaattccatcttgaaaaaacaaaaaagaaaaaagaaaaaaaagaaagaaagaaaaagaaaaagaaaataataacaaaaccaataatacaaaggaaccacagcagcaacaaccatttgctcaatgctaggcacaaggtgctaccctaggtgttctacaggggtgagtgcacagaccagcacaactcgaagaggtctgtaatgttatttccatctcacagacagtgaaactattcagaggctcgataacttgcccaaaatcacatatctggtcagtagtggcgatgagatataactcagtttggctgaatctgaagtctgcactcttcactatgctatgggttagaatgagctgaactcaatagtaaacaaaaaataagtagacaaggaattattcaaatgtacaagagagcctacgggtctgcactagaatacttggcaatgcaaatacagagtgtgaggtgggacaaagacgatttgcaggaaaaaaagacaagctgaggttcaatcaaatagattcatatagcttgttaggtggatgaggtgggaggaggtggttgcttcccaacagctctttctcctcaattcccatttaagtgtctactccttctctgaagcctgtgagcctgaggggagggaagttacctcttgggctggggctggtggctcaggcctgagcctatcagcttagttccatcctttgtccatttactggctctgggatgggcatggcacccaatcagcatccgtgaaaccagacagaggcttgctaggggctgttgggaaggtttcttgcttttctaagaggccatctgaaaggagtcttctctgtggctcccagttgtgatttggaagcccacagcccttgaagctgctgccagcagtctcatgacagagcaaagccagcctcagcacgatgctaacactgcagagggcagagagatggagagaaactggggtacatgattctgtcctttgttgttcaaggcactctgcagtgggtttcctgttgcccaaacacgtcctaactgttacaataaggcaggctctgcaaggtgtctgttccaggctcctaacccaaaagtcactgccatacactttagtggagaacaaagaaacacacgaaaagcctagatccagggaaatgttgacgtgacacttgcgagcccctgctggaaaaaaaacaagtgaacaggatggagactagagacataacaagccaggcagagaaagtcaagcttccacaccctgtaagtttcctgggctacgtgttgacagcatacaagaaatttgtcatgtctgactctcacgtacctacagaatgcaggacaggcaaagctattctgcaggacccacatgactttgtacatggagagggttcttttcttctgatgctaagccctctaatatatttgggtcccaactggataaatgtctgatgcatacatttaaaaaaccaagtattatgcaaaccagggtatctttgaattcaagcaatgggtcaaagtaacaaacactgttctgtcaaaaaggatcaaacactttattcatctacacataacatatataaaagcaagcaaaatcaggatgttttcctcagccaccctttccacattttgtgcagttttagtgaactataaatcactgacttcttcaggcctaaaagagaaaagatgagaaagtaagaagatggaggcttgttgagtggatgctcagagtttcagtgacattctgagcagacttgtctttggaggagggcagtgaggggctgacccgtggctctaggagaccagggagctgaaggtgattaaaggtcactgtgatcaatgtagggggaaatgattctgatttcggcattttccgatttagggctatggatgccaacggttcctaagttattgggataagtgatccttttgagttatgaacatattggcagcctctgaatttagctctttcaaaaaggtaggacaaggataagactctgtatgccactgggtccccgttctctcaggcctaaattccaaccccacctcactgtctctatgtcactgtgaaaggcacctgtctgactatgacaaatgctgttcccatcactttctgcctcgttgacttggaatccctgtttggatttcttctctaggaagtgcttccctggacccacagggtggccccacagcatctgtgctcactcaacacactgtgcagtacgtgtgggccgattcacccacgcctctgcctggactgggagcttcctgaggacagggaccttgccctgttcacctaggtggccctgtcacctagtacaggacccagaacacagcaggtgctctgtgaaagcttttgaaatgacaagacaaatgtgcctcattcggagagctggccccctagcacccccatctacttagtcaggagtgtgtgatgaaactggagaaaggctctccgggggcttaggggaaagaagaaaaagggaataaaataaatgggtgttatttgtcagatctaagagtatcctatctgtggatgcgattatggactcaacttcctttgtgttgagggtgggatcattcagtttgtgtttcagggtgtggcccaaagatatgaacagtctttttcactgtgagacacaaactgtgatctgtgctatgagtgtaaagtgcacacccctggcagtgcactttggtgagcatgccgacaaggtaacaggtttcgctctggacatgcctagcactggggtttgagtgatggcttgaaaatatctggccctgttacctgtaaactgcttagtccacttagagccttggaaaagaccactgcagacagtggcaggggagcagtaaaatcattaatgaatacttccagacactctggcttcgtttgtctaccagctgactacttgcaaaccaacataacctagtcaacaaactcagagttcctttccctgcctccaccccttttaattttctccctggagcaaccactctggtaaaccccacccacttcagcattgagactagaagcttattatataaggtggtttttaaaattccagccagaaccaaccaaaagaccaagccgaatacaggtagttatacatggaaaggttcatatagcaaccccagggcactgagtcacagctagaggaggatgcatgggccatgataattcccagctcaacttcaaaaagcagttcctggatcttaaacatttaaggtaaatacataaagtagaagagtgtcaccatgtagccattttttttttttgttgctgctagtggacagaaatctcccttgactaaaacattctccctttcatggttctgccagtgagacattttcagaaagactgcagcagggaaatctgttagaaagagcactagaatcggagtcaagagacctggactctagttccaggtgggccacaaactaacagtggcctttccctgggcctcaatttccttatctgtaaaatgactgggttggaatagatgaggggttctctaacaaggggtccacagattaagtctgagtgtctgtgaactccctaacactgcaggaaaatctactgtgtgtgtgcgtaggtgcacttctgtgcagggcgtccagagttctagtcagattttcacagggatcctggacttgcaaaaggctaagaaccaacagatcagaatgaagagtcttttctgccttaatattataatttcaacagaggtggagaacttaaatttcatgattttggaataggcaaaaattttctaaacaggacacaaaaaactgctaaacatatagaaaacaaaatggataaactggactacatgaaattatgaacttcttttcaccaaaagacaccattaagagagtgaaatgacatggcttacagccataatcccaacacttagggaggccgaggcgggcagaccatgaggtcaggagatcaagaccaacctggccaacatggtgaaaccccgtctctactaaaaatacaaaaaattagccaggcgtggtggcatgtgcctgtagtcccagctacttaggaggctgggacaggggaatcgcttgagcccgggaagcggaggttgcaatgagccgagatcacgccactgcactccagcctggccacagagcaaggccccatctcaaaaaaaaaaaaaaaaaaaaaaaaagagagtgaaatgacaagccacggagtgggggattttgacatcacatgtatccaacaatggagttgtgccccgactacagagagaattcagtaagcaaaagagacaactcagtaggaaaatgagcagaagactagaatagacgcttcacaaaagagcatatccaaataaacaaatgaaaaatgctcaacttcctcagtcatgaggaaaatgtaaattaaaagatcaatatggtaccactagtcacccactagagtgcctaaaatgaaaaagacctaaacaggcattcagggaggtgctgcaacagaagctctgctagtgcaagtataaatgtggacgattgtttagcagtttctactaaagctgaacagtcacatgctttatcatccaggtattctacccctcagtacatacctgacaggaatgcatacacccacccaccaaaagacaggtacaaaaatattcacagcagcactacttctaatagtcccaagcgggaacaacccaagtatccatcaatagtagaatggatacattgcggtatattcacacagcagaatactgcactgggcagaaatgaaccactgctactcccaacacgatgaatctccctatgttataaatgaacagggaaaggcacaaaagaggacatgcttatacatggttaaaaaatgggtaaaacagaaccgtggcactgggagtcaggctggagcttactctcggagaagcaatgcctgtgacgggcatgaggggtactggggactggaatgactgtatttctttacctgggcactaggtctatgaggtgttccctttgtggaaattcatcagatttatgatttttgcacttttctatctatatggagatatttcctactaccagaaaatttagaatctttcatttatttggtcacacatagaacaaatatttattgagcacctgtataagcaagacactgaactagttgctagggatactggtacagataacagctatggtctctgccctcacagagtccacaatccatagacttctacttggtctacactaagcttactttcttcaatttttttttttttttttttactctgtcgcccaggttggagtgcagtggcataatcaaagctcactggagcctcgatcttctgggctcaagagatcctctctcctcatcttcctgagtagctggggctacaggtacatgccaccacgcccggctaattttattttatttttgtagagatggggtcttgctttgttgcccaggctggtcttgaacccttggcctcaagccatcctcccaccttagcctcccaaagtgctaggattacaggtgtgagcctctgtgcccagattacattaagcttactctttctacaggaaaggatgatgatttaggaattctgctcactccttccccagtggataaaaatgcaacatctctttagatgcattccctgtagagagatccttatttacctaaagctagtcattatgaattctggttagaatctaaagtcaggattttgttttagaagcatgcagaaagctatgtcactatatggctccttaggtttctcttctgatttccagcttgtttcacatgacctacagcgaagttaatacacacgtaagactatgaactccccgtgtgatcttaaaacagatgggctactgacagacaaactctccaggaaacaatgtgaggtagaaatatggctaggctgtgaaagatctctatctttccataatcttacgtttcagacctttgataaaattagtatccccaaaacatccttccagttcatttccaaccataagcagatatatcgacaaagaaaatctcttctgaggcaaaagtacaacttattttaagaactcacaggcttaagtgataagcaaatcagcaacagagcaccagtgttcttctaatttaaatatatagataccaacaaatggaagaaatgcttcagttttaagaaatcagaagcagaggataatgactaatccattctactgtgttcccggaaaaggctggtaaggatcaactgaggcatgccttttaggagcaagactgaacctgtcttgttaatttagtttagttgaatcttttgaagctagagaggtaaacaggtatttgtccccagagttaattctgattgaccacaaagtcaggtgggaaaaaataggatttaaaaattaaactcatcatcctcgcccaacctccccctctgctcagggaatgaatggctctactgcttcccaggccaaaaacctgggagttagttctgactcctccttcatgtcccatatccctttagtcaccaagacccagtcgttcccttctaaacacggcaaatctttcctgtctgaactgcaatgacctgagttcaggctgctgtaactcctcagctgactggctgtagccatatctatttggtctccctcgcaataggtttactgcccttccatttgatctctatgctctaactacggtagtctttcggcagtcctatggtgacttccctctgccctcaaaagaaaccctgaactccttaacatggcttttaaagtctttgtttggcccctgcttatctctccatctgatcactaaactcccccatttctcatctacctattcccacaccagagtactcagacagttccccttctctccactcgcgttagaaactttataaaaggctgctgctcgaatatgcagttgcttagctggtcttttgttgccagtttgagatgtgaggtcatctgctgctaccatgaaaggaagagcaggcaaattttaggaggctaaatagtcttttggtactcctaagccagctggcttcagttgctgatctgatgagaatgatgttattctactagcagcacagtctaagggaaattaaaacgatttgctaaataatcaactcccaggctaaaggaaaaggaaaacagtgtttggttttggaagcaattctctaatcacatttgaacatgagtgtatgtgatggtcagggaatttcaagggaactaataaagacaaagcatcagtgagactgcattgaggacatactgccatgttatccaacagtgtttactaggaagggcagtcctccgagctggttatagatgcctggcttccatcttttgtaggagtagagtgaaatttagatctacattcatctaaatttataaagcacctctggataacaccctggacgctctcatgtaagcctcagaacaccttgtgagttgggtattagtattcccaccacctcacagaagagagaataacataccatagtcatagagtgaagaaatgaataattcagaaccccaaaaccctatcctctgaccccaagcttagctccttcactaagcggattcccggaatttaactgaatttgacctttgtattggctggctaaggggaagaccaaatcttcctttttatcccatttatgagtaggaggttgcacaggggaggaggggtaatggctacaaaagaataaaaagtaaaccaaatatgctagggttttctcatcctacagatgacatacgagctggctgaaaaactgaacagaggcagaacttgagaaattttggggagaaggacctaaaaaagtaaggcagaacaacaacagctatgatgacaacaaaaggactcataaagaacaaggtggatctcagctcaaaagctccttcagctgataaacaacttcagtaaagtctcaggatacaaaaatcaatgtgcaaaaatcaccagcattccaatacaacaacaacagtcaagccaagagccaattaagaacgcaaccccattcacaactgccataaaaaggaatacatctaaccagggaggtgaaagatctctacaaggagaactacaaaacactgctcaaagaaatcagagatgacacaaacaaatggaaaactttcccatgttcatagatagaaagaaccaatactgttaaaatggtcatagtgcctaaagcaatttatatattcaaggctattcctattaaactaccaatgacattcttcacagaactagaaaaaaactattttaaaattcatatggaaccaaaagagcccgaatagccaaggcaacactaagcaaaaagaacaaagctggaggcctcatgctacccgacttcaaactataaatacagggctacagtaaccaaaacagcatggtgctggtacaaaaacagacacatagaccaatggaacagaacagagaacccggaaataaggctgcacacctacaactatctgatctttgacaaagtaggcagaaacaagcaatggggaaagaactccctattcaataaatggtgctgggaaaactggttagccatatgctgaagatcgaaactggacccttcctcataccatatacaaaaattaagtcaagatggattaaagacttaattgcaaagctataaaaaccctggaagacaacttaggcaataccattctggacataagaatgggcaaacatttcctgacaaagatgccaaaagcaattacaacaaaagcaaaaattttaaatgggatctaattaaactaaagagcttctgcgcagcaaaagaacaagacagtgaagaacagagtgaacagacaacctaggaaatgggagaaaattttgcaaactaggcatctgacaaaggctttatgtccagcatctataaagaacctaaacaaatttacaagaaaaaaaacaaacagccccattacaaagtgggcaaaggacatgaacagacacttttcaaaggaagacatacatgcagccaacaatcaaaggaaaaaaagctcaacatgactgactgataattagaggaatgcaaatcaaaatcacaatgagattccatctcacagcagtcagaatggttgtcattaagtcaagaaacaacagaagctggtgaggttgtggagaaaaaggaacatttatacactgctggcaggggtgtaaattagttcaaccactgtggaagacaatgtgccgattcctcaaaaacctaaaaagagaactgccatttgacccagcaagcctattactggagtacatacccaaaggaatataattcattatatcacaaggacacatgcatatgtatactcattgcagcattattcacaatagcaaagacatggaatcaacctaaatgcccatcaatcgtagactgcataaagaaaacgtggtacatatacaccatggaatactatgcagccataataaaaaagagaccatgtcctttgcagggatatagatggagctggaggccattatcctcagcaaactaacacagcaacagaaaaccaaatgctgcatattctcacttacaagtaggagttaaatgatgagaacacacaggacacatagaagggaacaacagacactggggcatactgatgggtgaaggatgggaggggtgagaggatcaggaaaaataactaatgggttctaactaggcttaataaataggtgacaaaataatctgtgtaacaaacttctatggcacaagtttacctgcataacaaacttgcacatgtaccccaaacttaaaataaaagttaaaaaaaaagaacaaggtggagaaggatagaggttctgaaacttactgtgaggatgaggaaagagaaacaggcaaaccagtcactcggtgcctgtcactgttagtttactccagctggagacctgggccaggggctaacactattcaaatatgacattgtaaagaggcttgttttaaagagaggtcaggaaacttttaggtaatgataccaaaagaagaaaaaccagacacaatgctagatgccttaatatatcttaaaatataatctcctggccaggtgcagtggcttaaccctataattccagcactttgggaggctgaggtgggaggatcacttgagcccaggagtttgaaacaagcctgggcaacatagtgggactccatctctacaaaaaacaaaaacaaaacaaaaaaacagccaggtgtggtattgcatcctttagacccaggtacttgggaggctaaagtgggaggatcacatcattgtactctagcctgggctagaacctgtctccaaaaaaacaaaacaaaaacaaaaaaacaaacgtaaaatacaccattgcactctggcctgagctagaacctgtctccaaaaaaacaaaacccaaaacaaacaaaaaaccaaacataatcttcacaacctggtgaggcaggcataattattcctatgaagttaaaactcagaaaaattaggtaacttgcccaagtcacactggttaggttgtaatttgagctctagtctctgcggctcacaaacctctgccctcagcactatgctaggaaacctttgtcacagcccttggccataataaacagagcagccagagcataaggccatttaacccacagaatctgaaggggtgctcatcactttccatgctttatgtcacctcagtgtgaggtaacatacattctgtcactctggacttccacaatgcaatgtggcatcattagaagtgaagaaaaggctgtgcaggaagagaggttaaaatgtttagaaaaatttatttaaggaaataatcaatgaaagcttcccaagtctagcaagtgtgtcagatatccagatacaagagacccaatgacccccaggtgaatacactgcaaaaaggacttcaacatagcatactataatcagaaggtctaaagtgaaagtaaaagaaacaattttaaaataagcaagagaaaagcatctagtcacccataaaggaaacctcatcagactaacagtggacttttcagcagaaaccttaaaggccagaagagaatgggatagcatttttaaagtgctgaaggaaaaaaaccctgtcacccaagaattttatatcctgctagaataagcttcataaatgaaagagactagtctttcctagacaaatactaatggaatctgtcaccactagaccagccctataggaaatgctcaaaggagtcttaaacatggaaacaaaacgctgatattcaccatcacaaaaatacccagaaatataaaactcacagttcttataaaacaatctcacaaaagaggaaaagaaagaaatcaaattacagaatttcatcaaaacacaaggacaaaaagagaaaaagaaagaaaacaaagaatttataaaataacttgaaaataaccatgtgacagaaacaaaacctcacatatcaatattaactttaaatgtaaatgcattaaatgcttcatttaaaagatacagactggcagaatggattaaaaaaacataatccacctatatgctacctacaagaaactcaccttacctgtgaagacacaaatagactgaaagtaaaggggtggaaaaagatattccatccaaaaagaaatcaaaaggagaactatatatatgtcaaataaaacagactctaaatcaaaaacagttaaaaaaaaaaaaaaagactaagaaggtcattatataatgataaagggatcagttcaccaaaagggtacagcaaatcctaaatatatatgcacccaacataggaccacccaaattcacaaaacaaatattactagctctaaagaaagagatagatagcaacacaataacagtgggggacttcgacattctactcacagcactatacagaccatcgaggcaaaaaattaacaaagaaacactggactttagaccaaatagacttaacagacatttacagaacattcttcccaacatctacagaatatatgttcttttcatcagcacataaaacattcttcaagcatgggctacatagggagactttgtctctacaaaaaataagattaaaaataaatgtagccaggcatggtggtatgtgcctgtggtcccagctactcaggaggctgaggtgagaggactgcttaaccttaggaggtcaaggctacagtaagccatgatcacaccactgcactccaccctgggcaacagagcaagaccctgtctcaagaaagaaaaaaaaaaaaaaggaagaagaaacattcttaaagatagatcacacatcacacattaggctacaaaacaagtcttaacaaattttaaaaaatcaaaatcaagtatcttctcagacaatagtagaataaagctagaaatcaacataagaggaacttcagaaatgatacaagtacatggaaattaaacagcatgcccctaaataatcacttaatcactgggttaatgaagatttttttcccctgagacccctgagacagggtcttactgtgtcacccaggctgtggtgtaatcatggctcaccgtagcctcaaactcctttggctcaagtgagactcctgcctcagcctcctgagtagctgggactacaggcacataccaccatgcacagctgcacagctaatttttttgtagaaatggggtttttccacgttgcccaggctggtttcaaactcctaggctcaagcaatccacccacctcagactcccaaagtgctgggattacaggcatgagccaccatgcctgaccttaaaaatttttggaaacaaataaaaatgaaaacacaacataccaaagcctgtgggatgcagcaaaagcagtgctaagagggcattactaatgtttacagcattacatgtctacataaaaaagtaggaagatcacaaattaacaacctaatgccatacctcaaggcattgaaaaatataacgaaaactataacaagaaaaaaaataactaaactcaaagttagcagaagaaaagaaataacaaagatcagagcagaactaaataaaatggagaccaaaaaacaatacaaagtatcaacaaaatgaaaagttgggactaggtgcagtggctcatgcctgtaatccctgcactttgggaggctgaggctggcggatcgagattctaggagttcaagaccagccagggcaatgtggcaaaatctcaccttgacaaaaaatacaaaagttagccaggcatggtagtgtgcactgtagtcccacctacttgaaaggctgaggtgggaggattgcttaagcctgggaggcaaatattctagtaagccatgattgtgccactgcaccgtgtagcctgagtgatagagccagaccctgactcaaaaaacaaaaaagaaaagttggttctttgaaagatacacaaaattgataaaccactagctaagactaagaagacaagagagatacaaataaacaagatacaagacaagaagagatacaaataaacacaatcagaaatgaaaaaggagacattacaactgataccacagacatacagaagatcatcagagactattataaacaactagatgtccacaaactagaaaacccagaggaaactgataaattcatggaaacataatcttcaagattgaaccaggaagaaacagagtatctgaaaagatcagtaatgtagtagcaagactgaatcactaataaaaatctcccaagaacaaaaagaagcccaggacctgatggagtcacagctgaactctaccaaacacagaaagaatgaataccaatccttctgaaactattctaaaaagatcaaggagggaattctccctaactcattctatgaggccgctatcaccttggtaccaaacagacaaggacacaacaccaccaaaaaagaaaattatagaccaatatccctgatgaacacagacacaaaaatcctcaacaaaatactagcaaattaaatccaacagcacatcaaaaagagaatacattatgatcaggtgggatttatcccagggatgcaaggatggttcaatatatacaaatcaataaatgtgatacatcacataaacagaattaaggacaaaaaccacatgattgtctaaatagatgcagaaaaagcattcaatagcctgggcacagtgacttatacctgtaatcccagcactttgggaggccaaggtgggcagatcacttgagatcaggaattcaaggccagcctggccaacatggtgaaactccgattttactaaaaatacaaaaattagccaggcatggtgatgcatgcctgtagtcccagctactcgggaggctgaggcagtagaattgcttgaacccaggaggcagaggttgctgcgagctgagattgcaccactgcactctagcctgggtgacagagattccgtctccagctactcaggaggctgaagggggagaatcgcttgaaaccaggaggtggaggttgcagtgaggtgagatcgcgccactatactccagcctgagcaacagagtgaggcagttgctctgtctcacaaaaaaaaacaaaaaacaaaaaacagatgttggtgcagatgtggagaaaagggaatgcttatacactgttgaagggaatctaaattagtatagcctttatgggaaacagtatggagatttcttaaagacctaaaaatagaattaacctttgatctagcaatcccattactatgtatacatccaaaaggaaagaaatcattatatcaaaaacaaaaacaaaaaaaaccactcgtatgtttactgcagcactagtcacaatagcaatgatatggaattaaccaaagtgtccatcaatggaggactggataacaaaaatgtgtatatatctacatctatatctcaccttgaatactacttagccataacaaagaatgaaataatgtcttttgcagcaagatggatagaactggaggccacgtgtataagtgaaataactcagaaacagaaattcaagtatcacatgttctcactttaagtgggagctaaacaatgtgtatgcatgagcatacagaatagaatgacactggtgactataaaaagtgtgagggtgggaggagatgagggttggaaaattacctattgggtacaatattcactatttgggtgatgatgggtacactaaaagcccagacttcaccatgtaagaaaaatgcacttgtattccttaaacgttttaaaaattaaaaagaaaaaaaagtgaaggggaagcaagcagtaagcactcaggggaagcagcatcagcactccagggccacaaggacagctgagctgtgggttctgtgatcaactgccctctgctggtgagtagaaataatgagtggaaagaggaccaaaggctcatttcaggttgaaggtgtcaagaagatctttttcagccttttattagagaaaaattcaaacttaaataacagacagaagagtataaaacagccccatgcatctttacctagctttgacaatatatcagctcatggccaatcttgtgtcatctacccattacccactgccctctgccatgttttattttgaagcaaatcccagacaacatatcattgcatctggaattattttagtatgcatctctaaaagaaagggaattttttaaaaagctccataacaccaccattgtcacaactgaaaaataattaacaataattctaataattccaataattccttatagcatgggacgccaacaacaaaacaaatcattaagcctcacccaaggaggatcatggcaagggaaaggcaatcatgcaaaattcagattaacagcatgaatcacccaaacaaacaaaagtacctcatcttcagtcttgccagagtaaactagcaggaacatagattaaatgaatatcttaactggaaatgcaaagccatgcacccaaatggtaggaaaatctttagttcagcagatgtgacacaagtgctactaagtctttgttgaaacttttatacaatgtttttattattataattttttttttttttgagacagggtctcactctgtcacccagactgaagtgcagtggtgcgttcttagctcaatgccgcctcgacttcctgggctcaggactacgggcgcgcaccaccacgcccagcccttttttttttttttttttttttttttttgagacgaagtctcactctcgcccaggccagaggcagtggcacaatcttggctcactgcaacttccgcctcccaggttcaagcaattctcctgcctcagccgctcaaaggtgggactacaggcatgtgccaccacgcccagctaattttttgtattttagtagagacggggtttcaccatgttgcccaggctggtctcaaacccctgagctcgggcaatctgcctgtctcggcctcccaaagtactaggattacaggcatgagtcaccacatccagcctattttttctatttttttagagacagggttccaccatgttgcccaggctgatctcaaactccaggactcaagtgatcctcctgccttggcctcccaaagtgctgggattataggtgtgagccaccgcatctggcctatttttgttatttttaaagagacagggtcttgctgtgttgcccagactggtcttgaactcttgagcccaagcaatcctcccgccctggcctcccaaagtgctgggattataagtgtgagccaccatgcctggccttgttgaatctttccagtgattcaggagggcaacacggtccttgagggccaaatgctcagaggagtatccaagcagctgggctatgagacactgagaggtgtgaccataccagctccccagcaatctcaaacccagggattagaattaggttgaaagatcactcccctttttgggctacctctgtgctatttctccctctcttgcaaatttctgttagcatgtctcttttcccttctaaattatacgcctctgcaagtcagtatagcatttgatatggtttggctctgtgttcccacccaaatcttaccctgaattgtaataatccccacgtcgtgggagggacctggtgggaggtaattgaatcacgaaggcaggtctttcctgtgctgttttcataatagtgaataagtgttacgagatctgatggttctataaaagggagctcccctgcacatgctctcttgcctgccgccatgtaagacatgattttgctcctcattcaccttccgccatgattctgagacacccccagccatgtggaactgctaatcaattaaacctctttcctttataaattacccagtctgaggtatgtctttattagcagcatgagaacagactaacgcagcgttgtgttcacttttgtatcccgagcagctggcacatgagagatgctcaatggatgcttgcatgaagaaagcctgaactagaaaagtctatcacttgatgatgccaaatgttggaaaaaatgggaagaaaagagtattctcctactctgcttgtgggacgatgaactgatacagccactttgtcctccaaagagatgtcaaatatttaggccataaaacaagaataggatgcaaaaaacaggagcattcagagaacagcaagaaaagagagagttcctggaaattataaacactcaacagaagggttggaagctaaagttgagaaattcgagaaaatcttccaaagcagagcaaaagaaaaacagataaaaaatagaagacaaaagaaagaaaaccaaagactaatctagggggtgcaatatctgaataaaaggagttccagaaagagaacagagaaaacagatgggacaaaattaaagaaaaaatttaaaacatttttcttatatgcttatattctgagtttcccaacagaaagggcaatgaattcccggtaaaacagataaaacagataaaaacagactcacatcaaagcacatcactgagagaattcagagcactggggaaaaataaagacctaacatgcttccagaaataacatacacaaaggattaagaatcagattggctttagacatagacaacaatcctagaagtaaaagataaatgcagcaatgatctcaaaattttaaaggaaagtgatttctaatcaatacccagcctaagtattaactatgggtgaagacagacaaaaaagactttcagacatacgtggtctccaaatgtgccttccatgttccccttctcaggaaattactggaaaatgtgcttcaccaaaatgagagtgtgcaccaagcaagtgaaagacatgagatacagtaaatgggggaccccctagaggggacagcgaagacactctccatgagagaagaacattatgcagggaaggaaaggtgtactctgtggctcaccataccatcaaactgaaaactaattagccaaaaccaccagacaactatattaggaggacagagggatgggagggtgcgtacatttgatgagggtgggtgccagagttgacttctaacctcccatagagagaagtcaatagatgatacctaaagttgaaacgtagagaaggagcaacgaaaacttaccatttagagaaatggcagtaacaacaaaaataacccactaagacagatggaagcagttgtctcagagaaggggaagaggagggggagcacagatgctgctgtttttgcaatcctatgcatctgtaactttgataaataaaacaatatgagggaaaaaccctgcacacaggaagtgtctcagaaaattcagaagggcagtaaagcttccaacagcactgccaatggtctgacattgttcgaccaccaggttctgctgctgttatgcctgtttgtaccttactgcaatatcccagtttatggccatcaaagctcagcatttcacaagcacctaaaagatacaaagctttacactgtaaccaagagtgtggaagccactcagtcagcaggtatgttacacacggatttccaaagctcttaccagcagtaaaaatgcctttcgtgctctgtcttatactagacggtctcacgattgctgaaagccctgcgagaaaaaaaccaaaaaggagaccaaaaaaacccaaaacagatgttagtcatcttaacagttttaaaacttgaaactaaatattctttctagtcagccaatcaaaccaccaaatctatctctgtcctgctgtcacagtgacaatgaaaagggcagtgggattgagggccaggagaccagagcagccagccgtggcgccacccggctgtgtgagtccaagccgatgaccgaacagctctgtgcctcttccccttaaaacaaggggatgggttagctgaccctcaaagggcattttatgacttaaatctgcttgagatttctggttctcaattccataacatgaaaagataaaaaccaaatgattacatctacgagaaaaactttcattctgaaaacacacatacggattccacagtgaggaacaagtttcactcacctcaaagagacggcccagatcacactgttgccaggatcatgttcaaacaaacaacagtgtgcctcgtacagagctatcttcaggatggggagctggtgacctaaacacacactctgcaaacctagtgcaggcccaggaggagagtgggcgtggagcgcctgctgcagctcatccactgcagtgcgatggtctttgcaaagcattactggaaattctatctggcacgcggaggagctcagtaaatatttactgaatgaaaacaggagaatgcactcaattgacagagggactcattctcaatttcataaatatttcttgattgactgatctcataaattacctttagcaccttaaagggaagttagtctctgaagataaggttcaggctcttttttttgtttgttttttaagagatacgggctgctctatcaccaagcctggagtgtagtggtgcgatcctagctcattgcagcctccaactgctcaagcgatcctcccacctcagactcccaagttagctgagattataggcatgtgccaccatgcccagctacttttgtaatttttgcagagacagggtcttgctctgttgcccaagctggtctcaaactcctggcctcaagtgattctccctcctggacttcctaaagtgttgggagtacaggcgtgagccactgcacctggcctgggttcagagttttggataaacatcagggcagtgctggggaaaatgctgtggaacgtgggccatgtctgagggaatgtactcaacaatgtatgagacacatcaaatggagttgattgaggaaagctgtgttctcgatgttataaaagcacaaaaaaatgccaccaatctcttttctcagaccaccacaaaacacagacacatcttttaaataaattctagaagttgtgctctaggaaccaaaagaaacattgtttctccctttgacagtgatttaggatccaggaatttaaaaacagaagtattttcaccatcttacttcaaacaaataaaaatgcagatttagaaaaccctcaaatttttagtgctttcttcttctgagaggcaatctctctatctcgctaaacaaaaaggaagaaataatacattccaatcacaaacaaagtctgcttttccccatggctggcatttcctcaacatcaaattcataaacgtacctagtcgcaccacatctccacagtcgggatcatgagccacttggaataaagtttcttccacatctctgttttttccaggagggtccataatatgatttatctgttgctgtaaggttttgggcaatgtcatcagctgagtgaactgtccttctgggcttttatctatctgaagggaggaaaaaaaagacgacgtctatggaagtgctttaaatcctacaaatactccaaaactcagggcttctctttaaaaatcacacaaacatatatgcacccacacccctggcgaggcagcaagctaaggaaactctctttttctgaaactgaatgggtaagtgttcaggagtctaagtcccttcaaaaaggacaattcttgtcctataatattccatttctacctgagaaaagaatagaagccactctcaaggatcaatttctgacttttggttttaaaatttatatttgtcttaaatccagcagtcaaaggaagtggtgctgcagttgacactcgtggaggccgcgtcaaatccaggcactgagatgacccctcccatttcaaacacagggagactggcgtgccctgatcacatcaccaatgagagtaagtgggatctgaattgtgtctcctgcctgtagggccttttagtatgctgtatttcacaaactgtaggaatacactgatgacagaaactaatcttacttacttttaatccccagcacacagtaggtactcaaaaaacaataaggaaatgagtaactgaatcaatacaacttagttgtcctaaagctactatgccagcggcttcggttcccaaagtattctaaaacatactaaggtgctgaagataaatatataaataaaacatgtaaaactatgtgtcagactttactcagaaacccttgaatcaaaagttagccacagagctgaggccagacctagctttcctaactccaagtttcatacactgtgcctcgtggaatgaatttttaaaaatcttgtaaacattgatttcctgccaagtgcagaaccagtaacactgccctcaacagcccatcacattatttcccaaggaagaatctgtcttgtatccttttaacaaatatttaggttttaacttcaactaagagaagagtaagaaaaaatcagatcaatgtattacattttaggcttagagtttacagataggacgaactttcttaataattagaatccactcattctaccattttttaaattgaataaatatttattaagtacataccaaatgggccaggagcacaggttcacacctgtaatcccaacagtttgggaggctgaggcaggagaattgcttgagcacaaaaattcaacatcagccctagcaaaagagtgagatatccggctctacgaaaaaaaaaaagaaaacaaaaaaaagccagacatggtggtgcaagcctacagttctgtctacttgggaggctgaggtgggaggatcacttgagcctgggaagttgaggctacgatgagtggtgattgtgccactgcactacagcctgggtgacaagaccaagatggtatcaaaaaaaacaaaaaagtatataccaaatacctgaattttctagttttgtctataaactctatgaagagaaggagaaaaatgttattatttaatggctccataaagctagaggggtaaatatttaggtttttatctaaatatttgatatttatcactaggatggttctaaattcacaggccccatcctctacttagctttggctacaaaaatgacaacaaatttgagtatttatgtaaaataatcttagaaatgacatttatggacttatgttttgaggccacatattgggattagttagaataaacttatatttaagttatgctttacctatgaagcttccaacggcttgagtgacatataaaaaaattagaaagtacttatctgccactgctttctcttgaggaaaataatgcactggaattttcacttgaaagcatgagtgtaaagataaaataccaggtgacatgatttaaaaatttggtaaattctcattttccttacactaactctcattaaaataacgaaagtgaaagcattcagctaaactgtgaaagtcaaattgcattttaaaagcggacatggatacaattattatatgtcaacttaagaaaaaagcagatatggaaaaaactttatatgattccatgcatatgaactgtccagaacagaaaaattacagagacagaagtggattagtggttgcctgggtgaggggagagctggggacggctaaagggtatggagtgacagaaatattctaaaattacattgtggtgatggctgtgcagctctgtgactatactataaacactagcttttatggtgtatgaggtattcatcaataaagctaatattttgttattattatttttgagacagagtctcgctctgttgcccaggctggagtgcagtggcgcgatctcagctcgctgcaacctccatctcctaggctcaagtgattctcatgcctcagcctcccgagtagctgggattacaggcgcacaccaccatgcctggctaatttttgtatttttagtagagatggggtttcaccatgttggccaggctagttttgaactcctggcctcaactgatccacccacctcagcctcccaaagtgctgggattaaaggcatgaagctgccattctctccccctggccaaaagagtaaagaaaaaataaaaccatatcccaggacgaatggcagagatgagcaccacctgtagacctaaaagatgcaagggtaaggcagataattttatgtgtcaactcagagcagtggcacagcctgaagacactgtcctgcgaggatgagttgtgctacacatcctgaatcaatcaccattacgctgtactatattcccaactggcagaagacatgggcctggggaccaagggtagaaagagaagtgaccttgcttatcgtcattcccagggacccacttgggaacactttgcttcctatcactacagctctagatctgtgggtctagaggtcccagttcccagagaagggatgcttctaccagaggacatagtaagcatcccattaactttaagttacgactgccacccaattaatttagaatcccatgccgtaagtccagcagacaaggcaatgagtcactacactggcagaagcaatcggccctggtcatcaggagctggggtgctgatacacgtctcttagagtaccccttgcccaattttgatggttagtggacaagtgcggtagccagggtcctccagactcctccgagatgagggtctgggccaccctgtctagataagcagaagtgatagatgagggtgaagggaatctggaggagtagcagagatgggagaagatgagtctcagttgcagcctcaaggccagatacagcactgggagctgtagctcagtcccccagtcttattcttgtaagtttcctgggaaaagaaactgatgcgaaactagatcatgcaggcttttataggccatagggaggattctggatacctttatttttatagttagagaaaattcctagcccttttcccttgttcagtttctagaaagttggtagacagacacattatacttccctgtcctctagccagagaatagaagatctctggagaaattctacagacactgatatttgagatcctccaataaaacagctaggtccttggccaggtgcagtggctcacaccagtaatcccagcactttgggaggctgaagcgggcagattacttgaggtcaggagttcaagactagcttggccaatatggtgaaacctcatctctactaaaaatacaaaaattagctgggtgtgatggtgcatgcctgtagttccagctatttgggaggctgaggcacaagaatcgcttgaacttgggaggcggaggttgcagtgagccgagattgcgccactgcactccagcctgggcaacaaagaaagactccatctcaaaaaaacaaaacaaaacaaaatagctaggtctttgcctcataatcctatagtcaagcccaccagttgacaagcctgatatatcacaaagaacttccagcctgtattttagtgcctcattctttaaaaacaggccagagccaggaacggtggctcttgcctgtaatcccagtactttgggaggccaaggcaggaggatcgcttgagcccaggagttcgagaccagccagggccaacaaagtgggaccctgtctctacaaaaaaaaatttaatgtctcagatcatatgggtacaaatatatgtgtgtgtgtgtgtgtgtgtgtgtgtgtatgtatgtatatatatgtatatatgtatatatgtgtatatatgtatatatgtgtgtatatatgtatatatgtgtgtatatatgtgtatatatatgtatatatacatatacacacatacacacacacctgtgtatacacacacacacacacacacacacacacataaaaaaatcagctgggcatagtggcatgggcctgtagtcgcagctcctcaagaggctgaggtgagaggatcacttgagtgcaagagttcaaggctgcagtgagctatgatcatgccactatactgtagcctaggtgacagagtgaaatcccctctcaaattgattaattcattaattaatttaaaaaatcaggccaggaaggaaactcagacatttgaaaaaagcttctaacataacagactagagtaaaaacagacaagaggaactaagagaaagaaaacagtgtgagagaacaagacaaaatcttcaaaagttataataaagatcattaaagagattaggagaaaataatgcatccataatacaagaataggaagctataagaaagaacattttgggaaaattaaaaatttagtagaagtgttagaaaaccaatcagaaatattctcccataaagctaaatttaataaacgaagagacgagagagagagagagagagaaaggaaaaaaggttaaaccaggaggtctagcaaccacctaacaggaatcccaggaagaacaaactaagaaaatgggtatgaagaaataattacagaaataataaaaaaaattccttagaattgaagcttataaaattccagatagaaaaggcccactgaggctgggcgctgtggctcacaccagttaacccaatactttggaagaccaaggtgggaggatggcttgagcccaggagtttgagaccagcctgggcaatatggtgaaactgtttctactaaaaacacaaaaaccagccaggcgtggtggcgcgtgcctgtagtcccagtagttactcaggaggttgaggtgggagagtcacttgagcttgggagtttgaggtcgcagtgagctgggattacgcctctgcactctagccagggcaactgagcaaggccctgtcaaaaaagagaaagaaagaaaagaaagaaagaaagagcccaccaagtgactgaataatgaatggaaaacagacataaataaagaaggaaaattatctccaccctagaatttgatatctagccaatactatctatcaaagggagggtagaattttcagaggtatatagtctcaaaaacttgcctccctcacaccctttaagaaggtaataaaagacaaacttcactaatatcagagtataaaccgtggaagaggaaaatgcaagacccacaaaaccaaaaactagcacgggggaggcaaagggaattctcagggtgataatgaagggaaggtggaggagtgcggctgtgcagtgagctagaaaacaaccagttgagaaaggaacagggcagggggctccaggaaaaacattcctgtgagaaacaagaaacagaaaatacccaataaatctgtctataatgggaagagttttacggatctgtcaagagtttgaggatgactgacctaagcaactgaaaaaataagacaactattaactccaggagaaacaaagttgtacaggaaaaggaacttcataatgccacagctcatcaataaagaaaaggctgtcacaataaaataaacattgaatattaagctaacaaaaaatatgaagtaactttatgtgaagcatgagggcgtgaggtagaaggggaagagaatgtgtgtgctaagtgcatgtgtgtgagtgtgtaattggtataagaattgatggggtagtgtaagacggtaaaaaaaatccccttcttccaggatggcaaaaataaagtgtaagattgaaaaaaaatcaagaaataatagtcgaagcatattatttagaacatggaggtgaatatcagaagaatcagctatagagacgaaagcagctgcctctggtaagcagggctgagaatgtgggaacgtatgcagcacggaactgctctttttgttataaacttgaggtatcatttggcttttaaatcatgtacatgcataaaacaaaaaacctcaacctgaaccaaatgtggcaaaatctgttaaactgagtggtgggtattctcgcatttcatatgtcactctctattcttttcttgttttaaaataattcctatttttttaaattccctttttagctctagaaattccattaatctattactcattacaatgttagttgcccctactatgtggatggagaagagcataaatgaagaaaaatacagtgttctttacattaaaggaaaaaaaaaaaaacctttggcccggcctggtttttattttcaaacaaacacttaatattaattgaaacaataccttgataagaaagttttatttgatatatcaaaaagaaaaattcccagacataataaacaaaacaagtggggaaagaagagaattttgaatatgtatgagcccattaatgtataacaaaaccaaacctcttcctatatgcatacaaacatatacaaaagtacacgtgaaaagatctggaagaacagacagcaggctgggtgcagtggctcatccctataatcccagtacttttggacgctggggcgggcagactgcttgagctcaagagtttgagaccagcctgtgcaacatggcaaaaccctgtctctacaaaaaaaatacaaaaattggccaggtgtggtggcatgcacctgtagtcccagctactcaggaggctgaggtgggaggatggcttgatcccaggctggggggtgttgaggctgcagtaagccgagatcgtgccactgcactctagcctgggaacagagtcagaccctgtccccccaaaaaaagaaaaaaaaacaacaacaaccagacaccaaactgtcagtacagttacctctggggagctaaatgggtctggggatggaatgagagtgatctaaaagtttattttcacttgttttgattggtaattgatagacatggtaataatttccaatggcaaaaaagatatacatggtcaaaacaagtccctctcccacttctgcccctagttcccttctccaaaggcagcctcttattactagtctgttaccttttagcattattccagatacacagaagcctatgtttacatacagtacttactttttaaactataaatgttctcacaccagtcatgctgttctacccctgactttcttcctgcaaatagcctttgtcttagaaacaatacaagctattttccacatacagttacctccagccagccttgctggcttttatacaccacttgaggattttcctgtagtatgctgccatagagctctcgaaagtgggctatattgggcttcacaatattcaacacttttgttttatcttctccaaccaccatccgaaagtcacctagttaaaacaaagagataaacacatcttccattaagaatccacactctcgacctatgaacgacgctccccacactgataccgcacgggttcactctggcaggatccctcatcagaacacttgcttttcctcctcaaaacctggacactttaccccaagaaatgtgagcacttgtttggaggaaaagagggtctctcaaatcacaaagccctttatgccagttaaattatagttacctagttacacaaggtaatcacaagcgagtagctaacttgttttagcttttccaatgcagaagcttctgtacctacaaagtcttgtcttatgggccaaattctgcctgtggccaatgaaggagataggagctgtgcaccatcactgtagacttgtccttgccattgcttcctcatcgttgacctgtctgtttatgagggcttttgaggcacttgatgaatataatcttatcatattttacaaaggcaaaataaggcttaaaagttctgtaagaggaggtttgcatttaagatgaaattgaaaacagatataactttttaaattgcaagtgatgagaaatgaggaatgttacatttgcctatgggatgaattgagctgaaaaacacctaattctgaaagacaaaagcatttctgaatcaaatgaaaagtgccctgccaatgccactgacaaccatcggcaagatggaggagaaaggaatgggaaagtggacacacttaagtgcatgcctactgggctaatgtgaaatcacaagaggctggacacacgcagaaccttctgagtcaagcgtggtgaaagcaatgtggctgaatcctttgttggagagggagcaaattgtcagggggagtagagaggtggcaagtgtaggcagataacccagctgctgaggaatcccctggggctaggatgacaatataatttatcatccaaactaggtcacttctgagggtgaagggatcgctataaataatcacactacgacaagtataaactgagcaaaccaggacatatggttaccctcgccaatttcttttttctggagaggggaagggatcatagaggtcattatttgccacaatggattttcctagtgcaaactgttggcttgttttagaaaaagtaaaaatacaaggaagaccaacaatatgtacttcattgagtaaggaataaaatatgctaggttttaagcttcaaaggaccaacttacactacaatttggtggaatgcaactggggactgcaagcttagaaaaacagacttccaggctgggcgcggtggctcacacctgtaatcccagcactttgggaagccgaggcaggcggatcacgaggtcaggagatccagaccatcctggctaacacagtgaaatcccgtctctactaaaaaatacaaaaaaattagccagacgtggtggcaggcgcctgtagtcccagctacttgggggggggccgcaggagaatggcgtgaacccaggaggcagagcttgcagtgagccgagatcgcgccactgcactccagcctgggtgatgaagcaagactccatctcaaaaaaaaaaaaaaaagacttctaaagagcctctggaacccgatcttggtgtacagggggtctgactgttcaggtgagtgagcagaagcgagtcccagtcctaaaaatctgctcaaatatggatgaacttgtttttgtcactattattttgaagggaaagagagttagatagttaaaacctgggatcactgctaatgaggaggttgagaaatcagtcctttcacatattgctgttgactgcataaactgctaaaattcttctggaaagcactgaagcaagaaaccccatctctggagcaagcttaaagaaataagccagaaacacagagtaagacagaaacacacaggtaacgtttaccgagcatctggtaaataccagccactgtgccaagtgtgttgtggtattgcttcatttaatacacacagctctcctctcaggtagataggattctatccccattcatacacaagggaacaaagacagtgattaagaaacttgcgtaaggtttccaggaagtaaaaatatactacatatataaaattgctcactgaagcactacttataatactgaaagcatcccaaatgtccaacaacaggggaaagaatgcactatgatggcatatggttactatcacagacagtaatcacacacaacaagatggaaagtgatcatttaatatgcagtaagaaacaaagagatacaaaagtataacaggctgggcatggtggctcacatctatagtcctagcactttgtgaggccaaggccgggggaatgtttgagctcaggagttcgagaccagcctgggcaacatagcgagactctgtctctatgtaattttttttttaagcataccaaaacaaaaaaaacttcataaaaaatgagaaaaacaagacaaagagactatataaaaatgcttatttttgctctaataaaatacatttattgtgggtttttgcatgtgtgctttaatttgctatctcatttggtcatggcaaagctccataaaataagtactattattcttaattttacagatgaggagatggacgtgcaaagacaacatgccccaggtccaactgcctctcggtattagggtagtgaaattttaggtgatgattttactctataatttccccccatttccctcacttctataatgctggcatattactttctagcattttaaaacacatttatgggatacacagatgatgacgtgacaaatgtgaatggagtggtggctgagttaacttccaactgtgtaaatccttacacgtataaaaatggattccattaatctttgaagagatgaaatgtcatcaaattctgactctaacaaggctggccctgaagtgaaagatcagtttctaaaactgttgaattctaaatatttgtgtcattccttctttctgtacattccacaaacaaaaagttcctcaattttagacagtcactttctgagagaaggatttaccattttaaaatatcaaggattatgttttacaatccaaatcttccccctaaaagaacaattgcatgccatgattaaaggacctagaaaacactccaggctctcggagaacaaggaccggggcttatttatgtctgcatccttagctccttgtgcactgcctggcacagggaacacatacatcaataaatgtgtgcagaactgaatttctctcactggtgtgcagctgaactagctcaaccgcaggggataggaagcaaatgggcttatgactcatttcttcagaacaaaatgaataacatcatgggcacagcacgaaccagcatctgatcataacaatcaatttttcttaccttgggagatttgttttcaacaaaactacagcaatggattaaaactgactgctgactttattttatgcctctagaactgccagtacaataggcatccaaaaggatttctccttgaccttgaaatgatacaaactccaaggcctgcaagccacctgtaggtggccttccctgtgattcaggcatgcagccagcagtcagggacctcattacaagtatgcagatgtgaagggctgcacagtacagcggcaaggccctggctttcaagtctggcaatgtcccagggtgactgaggtcaagttacttaaaccttctgagtccttcactgtaaaatggcttaatcacactaaccttacaaagttgctttcagatttaaggagttagggcagcagtccccaaactttctggcaccaggaagaggttttgtggaagacaatttttccatggatgtgggtccaggggacagtggtttcaggatgattcaagcacattacatttattgtgcacttcatttgttattattacattgtaatatataatgaaagaattatacaactcaccataatgtagaatcagtgggagtcctgagattattttcctgcaactagacagtccctctgggggtgatgggagacagtgacagatcaggcatttgattctcataaaaagcctgcaacctagattcctcatatatgcagttcaaataggtattgcgctcctataagaatccaacgcagctgctgatctgacaggaggcggagctcaggcagtaatgcaagtgatggagattggctgtcaatacaaatgaagctcgcccaccactcacctcccgctgtgcgtcctggttcctaacagggttcccaagggttggggaacccagagttaaggtattagagaatgctttgtaagtagtaaagcagatactacttatgatatgtatatagcatagtcgaaggatggagggtagaggaagcgctgggtcttggagataataattaccggctaacttttctccctttaaacgaattgcaagactgctgtcatttcagttcagtgaatatctgagtggctacaaagtaccaggagctgtgctaggcaatggagatccaggttgggcaaccctaatctgaacaccgaaaatgcaaaatacccccaaacctggaaaccttttgagcactggcaggacaccacaagtggaaaattccacacctgacctcatgcagtgagtcgcacatattattaaaaatatcatataaaatcactttcaggcgatgtgtatgaggtgtatatgaaacataaatgaacttcgtgtttagacctgggccgtccccaggatatctcattatatatgtgcaaacataccaaaatctgaaaaattccaaaatctaaaatacttctggccccaagtatttcagataagggatactcagcctgtccagatataggctctacctcaggcagcaaacagtatgaaaaaaagatcatttcagtgcagttttttatgtggtagtgtttaaggactgcagcccaaactggatattgatatggcaaaataatattcattttcatgactgtttttcagatataattcacataccatgtaattcatccatttaaagtaaataattcagtatttttaattctgtttacagagttgtacaatcatctctccaatctaatactagaatattccagcctccctacaagaaaccccatactcctaagtgatcactccccaactcccttcattccccatccccagcctgaatttaaacattgctgtcattttggttcagtgaatatttggctggctacaaagtaccaggagctgtgctagacaatggagatccaggttggatctaatctactttcttgccacagatttgcctattctggacattttatacacattgaattatacactatctggagttatttttacgaccttagcaaaatgttttcaagggtcatcacactgtagcatttatcagtacttcactcctgcttatggttaaataatagtccatcgtacagatgcaccaattttatttatccatttctcagttgatgaacatttgtgctgtttccacttttgggcgattcattatgaataatgctgctacgtacaagtttttgtgtggacatatgtttcatttctcataggtagatatataggagtagaactgctgggtcatatggtagctatgtttaacatttggaggaactgccaggcttttttccaaagcagctgtaccactttacaatctaatcagcaatgtatgagggtcccaatttctccacattctcaacacttgttcttgcctttcttttttatcacagccattgtagcaggtatagaatggcgtctctgtgatttgtattgatgtttccatttccctaatacctatgatgtttaacaacttttcatgtgcttactggccatttgaataccttttctgaagaaatggctattcaaatccttctcttgtttttaaactggattgtcttttcattgttttgttgttgttgttgtttttttttttttttttttgagacagagtcctgctctgttgcccaggctggagtgcagtggcatgatcttggctcactgcaacctccgcctcctggggtcaagctattctcctgcctcagcttcccaagtaactgggattacaggtgcacaccaccacgtccaactaattttttgtattttcagtagagacagggtttcaccatgttggccagactggtcttgaacccctgacctcaagtgatccaccagccttggcctcccaaagtgttgggattacaggcgtgagccactgcgcccggcctttccattgtgttttaaaaattctttatatattctggatactagtcccttatcagatgcatgatttgtaaacattttcttccattttgttagctgcctttttactttttttttttttttttttagacagagtctcactctgtcacccaggctagagtgcagtggcatgatctcagctcactgcaacctctgcttcctgggttcaagctgttctcctgcctcagcctccctagtagctgggactacaggtcaggtgtgtaccaccatgcccggctttttttttttttttgagacagagtcttactcggtcgccaggctggagtgcagtggcatgatctcggctcactgcaacctccgaatcctggggtcaagctagtctcctgcctcagcttcccaagtaactgggattacaggtgcacaccaccacatccaactaattttttgtattttcaatagagacagggtttcaccatgttggccagactggtctggaacccctgacctcaagtgatctaccagccttggcctcccaaagtgttgggattacaggcgtgagccactgcgcccggcctatccattgtattttaaaaattctttatatattctggatactagtcccttatcagatgcatgatttgtaaatattttttttttagacagagtctcactctgtcacccaggctagagtgcagtggcatgatctcagctcactgcaacctctgcttcctgggttcaagctattctcctgcctcagcctccctagtagctgggactacaggtgtgtgccaccatgcctggctaattttttttttttttttttttttgtgacaaagtctcgctctgttgtcaggctggagtgcagtggcaccatctcagctcactgcaaccttcgcccgcccggctaatttctgtatttttagtagagatggggtttcatcatgttggccaggttggtctcgaactcctgaccttgagtgatccatccgcctccacctcccaaagtgctgggattacaggcgtaagccaccatgcctggccttccttttgtatacattagaaaatacaaaagtaggaagtaatagggaggactcaggttcactatattggttcaggaaggaagcagtataatccactcatcaaatatttactgagcacctagtacatgtcacatactattggaagcatccaaacagaaggagcaaaacaagacaacaattccttccctccacatcctcagtggtggaacaaagaccaaagatcagccagccaaccaacaataagatacagtgtagccgactgtggaaagtgctatggggaaaacacaaacagggaaagacatagggagtggtggagttgcagtagcagtcagggaaggcctccatgataagccagaactgaggcccactggggtgggtgtggggaggggaggtgtgacccagtgggtcctggggaaggagtgacctaagtgtgaaccaggagtgacgcccaccaccaaagacctttcatagaacagtgaagtgttaagagcaagcattccaggaagaagactgcctgggttcaaatgctagctcggcatttacaagctatgtgacccagggcaagccacttaacttatctgggcatcagtatcctcaaatgaaaaaggggagcaataactagtttgtacatttcagggactgaatgaatgttacaatacctgacacacagtactagtctaaaaagtttgggtattgttcatgctttctatcccttcaggagtgctgcgttctcagaaattagcaaatgactactgagtaacctgagttccggctgaggcacagagaagcaggcttccaaagtcctgaggcagtcagctcccatatgctgatacaaccacactgcttgtaaggtttcagatggcttcatcaccacagaataaatcttactagcttccactccagagaaaacgtttctttactggcttctaccagaatccagaatccacactttagagagctggcactgaatgctaatttttttccccaagaatcactcaactggcaacttcctcactgcttcgtcttattcctagaagtagctgaggctgtgttcagacaatctggcaattaaagaaacccattctctctctcataggagagtgcccgaaagtgtttttcattccatgaggaccttaaccggccagatgaaatggggctgtcatgtttcaatccatctgatctaagtactcagctaattttttttttttttaatttaagaaacagggtctggctctgttgcccaggctggagtgcagtggtgtgatcatagttcactgcagcctggaagttgggattacaggtgtgagccacagcaccctgcaaattttgacaggcattgtttgtcaatatgtaacaagttttataatttttatagctgacaacataattccactttggagaacacatccaaggaagtcagtgcctcctttgcccctttcccaacgaaagtaatctgtacaaagtgattcacagcagtgttgctaataaaacagtgagaaatggagctaatataagtgtccatcaatcactggatgattgagcaaataacagtttctcaacctgaggaaaacccatctgaccaacaataatacataaaaataataataacagcaatcattttctgaacactgactattaatgagataagatgctggaggcagccaggcgcagtggcccacacctataatcccagcactcggggaggccgaggcgggaggatcgtttgagctcaggaattcgagaccagcagaagcacacagcgagcccctgtcgctacacaaacgaaattagccagccgtggtggcgtgtgcctgtggtcccagctacttgggagtctgaggtgggagggttgcttgggcccgggaggtcgaggctgcagtgagctatgatctcaccactgcactctagcttgggcgacagagtgagaccttgtctctcaaaaaaaaaaaaaaaaaaaaaaagatgttggaagctattatacgtattatctcattgataatttctttgtgagatagttatttgttttacaaataagaaaactgggggctcagaaaggttcaagcttgtgtttcaggaaataaaataatgaaaaacaaataaaacaaaaaagaaaggttcaagatacctttagaaagctggtattcaaactagtccaccatgtaccagatgagtgaccttagacagggaaccattctgggcctcagttttctcatctgtaaaatggggcaatgatacagcacccaaatcaaaaggttaatgtgaggattaaactagttaccaaatttaaagtattgagagtagtccttggcacccaataataaaggctattttccctgccattaagccacagacttcagtcacatcagtctactgctttcctcctaaacacatcatgttctttcacatccttcttgcctttttcacacgtgttgtttttcaagtctaccactgactcactgtgactgcatgttattaatgtgaagctccttagagcagaaattccatctgcagttcttcagggtatggaatgctaatttgcttgataaatattaaaccaaggaccattgcctaaaattagtcattttaatagttgtactgacataacaaagttcaaggtgactctttaaaatgcatttggtgctcctttcctgttcatttaaatgctgacttctaagaaaaactagagttagaaagctttctttctttcttttcttttctttttttttttttgagacacaagacagtctcactgtgtcatccaggctggagtgcactggcatgatcttggctcactgcaacctccacctcgccggttcaagtgattctcctgcctcaacctcgcaagtagctgggattacaggcatgcaccaccacgcctgactaatttttgtattttagtagagatggagttttgccatgttggccaggctggtcttgaactcctgacctcaagtgatctgcctgccttggcctctcaaattgctgggattacagggccaccacagctggctgggttagaaagctgtcttaaaacagaaaagaggaaaaaaaaaaaaaaaaaaaggaggggggtggaggaaaaataataaaaataaaaaataaaaaaagataaagctttctccttcccagtttgcagcctctcatcctccacctactctcttctcacccataatttataataatactgacctcagggcagtcaaagtaatcctaaaatactatataaaatgtaaaggattgttattgctacaaataataccaatctcgcctctgcctaagtaattactggcaggaacttgtccaacaacatggacagacatggtttttctgttccttctcctgcccactcccaggaaaaatactgaacttcacagattagggaccatatataatctcacaactggaaaaagatggacaatgcaaagttataaataaaaatgagattagtagacaatatgaattttggcatattctcagggcttcggagatttgggtggtttgccaagggatagaaaccaatcaattctacaacactgggttctcagaagcctacaaaagtcaggaggaaaatgtgcctttcaacactttgcctggggtaggtctcatacctatgaaagagatctacctacagagcctatgtcattttctaccttcattactctcttcttgttccagcaaaaatcagctaaacttggtagcagcttgaaggctaaattaaaagtcttcaaagaggtgaaagcagctatgtcatttggtaaatttccttagtaatattcagaatttagaaggaactcccagaatccatccaatgctacgaagatgttgactagaagggaagaaatggaggactggtagtggtaggggcagagtagagatcagtcctgcatcttctcccaccaagtcagctttcataaaaggcttccgttccatcatttttcacaggggagtatggaaaggtaatcactctaataaagtgacttcctttgctcacacagtgtgcatgtgacctgctcattccagcacagggccacgccactctttgcccctatgtcttttgttggaaggcagggaggctgccaggtgaagctggaagcacccagagaccaaggttgcttcaacgcctttctctacagtgttgcaaatacagccgtagtcatggtagatgaattttgggaagatggaagaacaaaacctctaaggtctcttacagcattaaatttccatgaaatcttacctgtctgtactgggatttggaggctaagtaaactgcttttccaatgttctgagcataaagttctttgactcatactcaaaaatcgggaaagatgattttttttaagatggtggttttcaaactttttaaaaagcggcagagcacttgttttgtaaatgaaatcttaaacggaaccttactatagtaaaaagatagatgggggctcctctggttgcagcgagggtgagtggccaggggctctaccctctcagttgtctcagtttgggacataatatgtgtgacctaccctcaaacagtttagaaaataaatatatatatagtatgtttacacatacagagaaaacagtggttctcaaagtgggatccctggaggggcatcagcatcacttgggaacttgtttctaaaaataaaaattattgggccctacctcaaacctattaaatcaactgtctggggtagggcccacgagtctgtgttttaacctgagacttcctagttgttcagacacaggctaaagtttgaaaaccactgatacagaaacaatgagaaaacaaatatggtgcaatgttaaaattggcgaatctgggaaaagggcatagggagttttctgtattattcttgaaacttttctgtaagtttgaaattacttcaaaataaaaattaacaaaaacaacaaaattaccctgggacaataagcatggagatgtggagaggggacccaggaggtagggaggcaaatcacgaggttagtgcaggaaccactcaagagtgacgtgatttacaactaagactgtagcagctccagggccgagtgagaacaggatatccgcagtcttcaaatataaatctctcccttgtagaacatctgggcagcaaccatactaacctgaataggagagaccggcaatctctatgaagaggtcttcttcagaaaagctttcggggagcatgaggaaagcagcggtcacagcactcttcagatttctatcgagggctgatctaagagtgacatcctcgttcactgagataattttcacctgaaagaagcagaacattgggaagaaaaattccagaagtggagtattgctcaagcatgggttacaaatgcactggaactatctcaaactctcttcccactgaagatcttggaatactggttcaggtgacacaaaattgttcctctaataagtaatcccagaatctccttgttttatgccaaggtcaaagaaatcatgacacaggaaaggatcaaaatgccaaagaaaacaaatattcttcttaaatgaggaaatgcagcataggtttagaaaaagagcaaaagtcctttggaaactttaatatttttaaattttataatctcactgtcgtcacttaattttttagtcgacagaggcattttacctctttatttagacctcatctgtaatcttggaccatatctaacataggaagttcatgctctatttcgcactttctagatacatcgattttgaacttgactaaggaaaaatgaaagaaaactagctacagtagaaaaagaacgggttttagagataggtatgggctcaagtccaggtacttactagctatgtgagtttgggcaaatgatttgcatcaaagaatcgtcacaaagattgactataataataaatgtaaagtgcctagaatactagcaactgcttcgctcagaaagaatttttctcctcaatacagagtagaagcttccatctgagactttctgcaaatccattaaaatacaaagagtgactgggtgtggtggctcacatctgtaatctcagcactttgggaggccaaagcagggggatcatgagaccagcctgggcaacatagtgagaccccatctctataaaacaaaaacaaaaaaaacaaacacctagccaggcacagtgatgcacatgtgtggtcccagatactcaggaggttgaggtaggaagacagcttcagtccaggtggttgaggctgcagtgggttgcagtgagccatgatcatgacactacactccagcctgaaagacacagttgagaccctgtctcaaaaaaaaaaaaaaatactaagagcttcagtctgttctgagattcttacttttaaagattgcactgcagttaagagatgtgttcaaatgccaactccatctcttactagctctgtgactatgggcataattccttatcagtaaaatggagtaaataacagaatcaagctcataaggctgctagaaagatcaagtgagttactgcacacaaacccttcagtgaaatgagcttccttgtgtgtgcttctcagtgcacaaggcaagagcttctctgggccagcggttctcatctttagctagcattagcttcacctggagaactcgttaaaatgtgtattatcggatgcaactcccagagttctgtttcaggaggcctcggtgagggctgaaaaatgtacatttctaacaagttcttaagcaatgcccagggaccacattttgagaattactgctctaaggtgcatacttagcactgtcaaattgctcttcagagtggttatgccaatttacactcgtaccatgatcttttaaaaacatcatactgtttctgattgactttctatacaaagtaaagggtctagaagtcccttaataaggactctcatatgtctaaaatatatctaccatctctaaatcttttggtactatcgacacattttctacctattctagaaaacagggcataagttgccttttatttgtcaaatacagataatttctgacaaaattaagatagcacataaaagacacactatgagaaactccaaaataaatattagaaagcaaggaaagaggagaatgctgcagtattccaaggcatagcttcttctcttctaattgtaaaaaacagtattataaaacatataactattattttataaatcaggcttcagaatctgaattcttttaccttttttccctacttttttctaagggagtatttgtaacatacaaacatcatatatggtaggtaagccacttgattcaataacaccccctcctcccttacaattctgaggacttaatggaccttaattaagcctttcagcacttaggtgagtttagtattactgcaatcatctgcagagagtaacccatgaccagccaggaacatgacttgcctacagttgcataatgagttgacaacaaaaatcaggatcacattcttttacttggcaaattcagctctaaatattctgaattattctcatgcattcatttagggttatattctggttaacttatcttgaaagatgattaaaacaaattttaaggtcctataaaaacacctatgcttattccttgaataactttcctaaaccttatagagttggctcttcgtatctgtgggttctgcacccatgggattcaaccaatcacagatgggaaacattcagaaaaacaaaaaaaaaaaatccacaaagttccaaaaagcaaatgttgaatttgctgccacatgccaattactacgttgaaggcaggcgaatgatgtgaagtgtaagcacggtattaggtattaacagtcatccagagatgatctaaaatataaaggaggatgtgcataagttatatgctaatactaggccattttatatcagagacgtgaattctgagggtgggtgcaggtcctaaaaccaatccccatggacaccaagggatgacagtattccatactgaatgattaatctaggagggcaactgcttcatcttactgacagaaaacttaggcctggaggggttaaaggggttaaaagatttctccaagagaagtagtggcgaactggaccgggatccagtcccaggattcacccagtgctctttccacaactctgtgatgtctctctacttccacattcccgttcttcatccccattcatcacacatccttctcaataattcttcacctctctgtttttgatggcttttacagaagcccagtgaaattagaagctattttgagatgctaacaattcaaagatgcaaagaaaagactaagtcttgggaaattttcccagttaacaaaataccacttgttctccaaggaagttgttctacataggctgtaagaaagcagtctgtttgctatttaagattaagaggatgaaaataaaagcatccttactcaaaggaaaaatgtcagttcggaagattctgctactgtgctgatctggttcttcaatgaaaggtgaactaggaacttgtctcagcagcactgttatttgttgttcagagtgaaaagccagtgaactcttgggacactgccagagaggcctgggaaaaaaagaaagtgctcagatttgtgaatagctgtttgtatcttactgggaatgccccgacctgaactgcatagataacattagcacgactgccagggaggaaaatctttactgtagagaaaggggcattggcttaaagggactttcaaaggagatatttgtgagtacctttcaagacaggaaaaaagagaaactcacatgtgggctcctctaaaactgtcacaaggagagactacttgaattgcagagtgaaattttaatcacaaagaccacagccctacctactgttcaaatactcaaccgcccaccagaacttttccattccaaacgaccaggaggtttaactcttctaaatagtcactgcttaaggatgaagaagaaacgctgaacattagagctggatgaaaccttactcaatatctacctgctggactctgggctcttcgaggacaagcaacatgatatcatttttaaaaattcctttggcatacacagagaagaaacagttgtcttttgaataaagaaatgaatgactcaatctgtgcatttcaaacgctagcggcccaaacatttgcttatagtagggcagagccaaaactagtaagccaggttttccaactcccagtttagggatcttttatagcactgggggtttttctatccacacaaaaaattaatcaacaaagctgcaatatggtgatagttgaactctgaatatagtaaaaatcattgaattgtactctttaaatggttgagctgtgtggtatgcgaattttatctcaataaagctgttattaaaaaataggccagacaagggggctcatgcctgtaatcctagcactttgagaggttgaggcaggtggatcccttcagcccaggagttcaagaccagtctgggcaacatggcaaaaccccatcttcacaaaaaaatacaaaaattagctgggcatggtggcacgtgcctatagttccggctactcaggaggctgagatgggaggattggttgagcccgggaggtcgagtaaattgtgttcatgccactccacttcagcctgggtgacaaagcaacactctgtctcaaaaataaaattaaaataaaataaagctacattactaaaaggcaaaatatattgcaatgaatacattaaatcaaaatcctcttaacaaggtggcaaaaaaaccactgcatgtcaatataaatgtcttaaaaactcaagcacaattatttatacactaaaaacaatgtaaaatacaaaaatccaaaattatgttaactaaggaaataactattaattattactttagaggtttcttggcttaaaaaaagtttggtcacaatgctatattaaacactttaaattccatgattttttacttgggaaaatattagtaaactcagaaacttaaggttgtactggaaataaaaatagggtattccatcaattatgagataagttaatggtaaagtatgataaaaatttaatttacactcaacttttcccagaaagtccatctttttaagcaagatactcaaatatatatatttggagacatggtcttgctctgtcatccagcttggagtgcagtggcatgatcttgactcactgcaacctccacctcctgggttcaagtgattctcctgcctcagcctccctagtagctgggattacaggtgcgcaccacctcgcctggctaatttttgcattttttagtagagacggggtttcaccatgttggccaggctggtctcgaactcctgacctcaggtgatccccctacctcagcctcccaaagtgctaggattataggcatgagccaccgcactcggcctatatcccttttaaagacttgaattactagtgattgaggaattctatttcaatttgcaagatgcaagacaattctggggctttagacaatgtaatttaatgtgattccttttaaaacacaaagataaagaattcatactcatattctcataattctttcttaagatatttacccaactttcttgtccaagatactaccaccctcttttcattagatttgttcaagtctgattaatatttgctgccacctagaggcacagatagtttgtttaaaaatcatcattctggttaacagtgatttccacatgttgaaaattgggagcaaggtagaagagagagttaatttgcccatttatcattctcaattaaaaaaaaaatatgttcatcactttcaaatgactttatgataccctaattttcttgtgctagaagcattaaaagccttagaaaataatcattgctatcagtaacattttcttctccaagtcagctgagaaatgcagagttttgcatgaaatgagcatgggtgctactacttgtcttgaattgctgtttttgttttataaggatataacagttagataaaacctgagctcatttccagtgcttacattctgagatttcatggcatttcagctttctaaagccttttttaaaattttgaaacattctaagcataaagtataatacaaagaacaatacaacattttaacattcaatttcatttctatctcaaaataactgagataagcaaaggcacagagagaaggcaaagaccattttctgagtgtctactaagtaccaggcatttcagaaccctctgaggtcagcgccatcagactcatctacagatgaaaacaccccgaggcttagggagactgtcagtggtgcagggtcacaacattaggaagcatcagagctgggattctaaccctacatctgttagattctgaaacactgagttcttcccagcagtactactctgcttccaatattccttttcctttttttttttttttttgagactgggtctcgctgcgtcacctaggctggagtgcggagtgcaatggcacgatcttggctcacctctgcctcccaagttccagcgattctcctgcctcagcctcccgagtagctgggattacaggtgcatgccgcaacgcccagttaattattgtatttttagtagagatggggttttgccatgttgtccaggctgttctcgaactcttggcctcaagtgatctgtctgcctcagcctcccaaagtgctgggattacaggcatgagtcactgcacccagccctgcttccaattttcaatacctttgtggacctttattctacagataactgaagttcagaaagataaaacaagatgcctaagtttatgtaacagctaataggtggcaggactgaatatgactcaaggcttctaatttcatgtccactattcttcccatcaagctatatattatgtttttgtttgtttgttttgagacagagtctcgctttgtcacccaggctggagtgcagtagcgcaatctcggctcactgcaacctccactttctgggttcaagtggttctcctgcctcagcctcccgaatggctgggattactggcgtgtgccaccacgcctggctaatttttgtatgttcagaagatctggggtttcactatgatggccaggctggtctcgaactcctgacctcaagtgatccacccgcctcagcctcccaaagtgctgagattacaggcgtgagccacagtgcctggcccatcttttgtatatttaaaacaaacaaacaaaacaaaaaacaaaacaaaaaacccttggaaataaaatatttacaaatttccaactgctcagttatgagctttactagtcatccaacttagaaatgagaaatgtatctgtatagacatgaaatttcagtaagcctatcatttctggactttaaaaaatgtttttaattaaagtaaaagttacagtgaagtgcacacatcttaagggtacagtttgataaatttgtccatgtgtatacctgtgtaacccctgcccggatcgagtatttctggacattttaaggagctacactatgaaattgtaagcccaggtgcaaagcaggagaatccagacagcccatgcacatcaataaagagatgtttatgacacaaaccagtgagctaaggctatggaaatctgtcatttttcccatagatagctacagaagcagcacatcactgttgggggagacactcgagaacaatctatcggcctcttgtggagcctgggaccctctcacgcacagtgaaaatcttccttatagtaggaagtgtgagattagcaactgtaaatatttaacacagtcctcaaactatggaaagaccctttctcagagcacagactgattatctggaaaaaaaaaaagaagaaagaaaagtgacattgcaaatacttgttaaaagtttaagttctctcccactttttttttttcctgttttgtgtttgtttcctgtttctactaaagcccagggagaagccgactccccacagcctcctctagctgtgtcccaaaagagctaagacaatagagaaagcatcaccactggcctgagaaagagaataaaagggatgggaacaccagtcccttggaatgactacttggtgcattcatttattcaatggttactgaaggatcccacgactcaggcactgcccttgggacgcatcagtggacaaacggtgcctccatgatacatgtcctagcagacaaggtgactgggtggtgctaagggaggctccactgaggcaccaggcacctcctctgccacccttcccccaaatgggtcaacttggagcccgatccagtcattggagaatcttgagggggagggcagcaggagggagagtggactgtgacccggcttctactcccagcacttctgacaccaaatgtgggtgtcacaccaaccaattctccagccctccagacaccaactgagtgtcctacaactgaattcgattctgaccctagctacctggagtcagagtcagatcccacaggttatgggctcagttccacaagcctcccccacttcagacaccaatcacaagtccaggctgcctgtactctgatcgttcacttgaaagggatgggggctacttcccctctcctctggtttcataatttgctagaatggctcacagagctcaggaaggcagttttttgttgctgttgtttttaagacggagtctcactctgtcgcccaggctggggtgcggtggtgtgatctcggctcattgcaatttccatctcccagattcacgcgattctcctgcctcagcctcccccagtagctgggattgcaggcatgtgccaccacgcccaggtaccttttttgtatttttagtagagacggggtttcaccactttggctaggctggtcttgaactcctgacctcaaatgatccgcccaccttggcctaccaaagtcctgggattacaggtgtgagccaccacacccagccgggaaggcacttttcttgcatgtacttggttattatgaaggacacaactgaggaaccgccaaatggaagaaatgcttggcaagatatggggtagcagaagggtgtggagcgccacgacttctccgggcatgtcaccctcccagcaccttgatgtgcttaccaacccagaagttctcagaacccccttttttttatggaggttccactgcctatgcacaactgattaaatcattggccgttggtgattggcccaatctccagcccttttcccctctgtgaaggtgggagtggggggcctgaaaggtccagcctcttatcacacggctggctccctggcaaccagccctatcctgaatctatctaggggcccatcaagagtcactttattagtataaactcaggtacgactgaaaggaacttgttatgaataataaaagaccctctcatccctaacactcagatattccaaagattttaggacctctgaaccaggagcccaaggaaaaaaaccaaatacatatttcttcttatatcacaatagaatatgtggatattatttggcaataaattttatagggaataggaagagtcagaaactcatttctatttccagagttccatctcattgcaatcacaatgatcaaagtaaggttaggctcagagaggaaaggcatccttaactgtgcagcctataaaacactcaccggtttttggagtcgtccagcaatgtataagttattccagttgaggagatcttcaatcagaacgttagtgctaataactccatatttgataagctgaaggaaaaaagaaatggcacaaaacggagtaaaataccatgttattgcttatacaagtataaaatataaggaaacagataaaattcttgaccagagcagtaccttgattccaaagccactcaaaacacctgacttgtgaaaacacacatctccaccaaaacttttgagaggttaagtgtccaagactgatttagcccctagggtatgtaaggggaggttgcaactgtcttcacaagattataacagagaagtctagcatggctgactccatcttgctgccagcctcacaggctggctatccaagctcatgcctgggcgtaggtcaagccaaccaaggaggaggaatatagtttatagtttaattttaaagcaaggatgataatagtccctccctaaaactgttcccctccccagtccagagctgaaatcccctttgtaaaactaatgaaagtccacaagattagggttatgggaagggcctgaattctgctaaaatgttgggatagtttctatgatgtcttactgctcaggagacatgtgtccagaggtcacaagacttgtgagttctccaattaatcctatagataacatcactactgtagaacctaaggttggtcttttgagatgttttcagacttttgcattccagcaactgactgaccccacccagaaccatgactcaacactcaattggtcctgttgcccctccctcagcaaaaggcccactcagcccatgaggactgttttccacacctgtatgattgcatccccaaccaatcagcagcacccattccctagtcccctgttcaccaaactatccttcaaaaaccctaactgccgagctttcagggagagtgatttgagtgacaacaccagttctcctgtgtgcccagcctcacgttaatgttaattaaactcattttttttttttttaagatggagtctcactctgtcacccaggctggagtgcactggcgcaatctcagctcaccacaacctccgcctcctgggttcaagccattcttgcacctcagcctcctgagtagctgggattacaggcacgcggtaccacatctggctaattttttgctatttttagtacagacaggatttcatcctgttggccaggctggtctcaaactcctgacctcaggtgatccactcgcctcggcctccaaaagtgttgggattacaggtgtgagctaccatgcccggcctgattaaactctttacagcaataccacagtcacagtgaaccgattttgtccatgcgacaggcaggaagaacccaccaggcaattacaaggtgaccactatttcaacttaggtccatgtgatgttaaaggtggaatggctcttagatgctatctagtattggtcctcagtggattgggagtaaaaaaaacttgtccttccccaaagacagtttgagaagtgataatttagttcatgttcctcatttgagaaataaaaaacctaaagctcagagacaacaaatgacatgctcaaggtggcaccagtagtagcagagtcaaaactaggtcccagaatttcagtctggtcttccaatgctcttttcattacaaagtacaagaaattttcctttaattagaagttttcactgacatgctttacatagtgaatttctcttttgctactgactatttcaaacacttttgtaattacaaagcaatatccaaaaataaaacttctttattcatgctaaaaaaagaaattatagttcagcccatttctatttttttttttttttttttttttttttgagacagagtcttactctgttgcccatgctggagtgcagtggcatgattttggctcactacagccctaactccctgggctccagtgatcctcccacctcagtctccagagtagctggaaccacaggcatgcaccatcacacctgactaatttttgtattttttgtagagacagggtttcaccatgttgcccaggctggtcttgaactcctgggctcaagcaatccatccaccttggcctcccaaagtgctaggattacaggcatgagctgccgtgcccggacagttaagcctatttcaataataatttgtataaatcctgtagatttcccaggttacaaagtcccatttgcataaacaagtatcttcagacccactttgctgaacctcagtatccaaacagccttctcaggctgcaaatatataaaaagcagttaaaaattatcaattaaaaagtagtcttttggcatataattatgcccaaacatttggttactggaacttataatattctttgaaaattactaattacaggtaggtttggcataatattaactgtggagaaagaacaaagctaagtgtcctgcatgactcaagtggatgcagaaggctgtgctgagtgtcagccttttccccccaactccagcagcagcactgcagaaagcccttctagctgcaggcaagtaaccactgggaggtaacagaaacaccacgggcctggaagtcaggggacctgttgcaaactagctgcacaaccttatggaagtcatttcctctctctgaacttcagtttcctcaactgcaaaatacaggtgaagcaaggttggatctcaaccggaaaagcaaatatatggcccaaggggtatgcagacgtcaccagtcaatcacaacactcactccttagccaagttcagacagaccttcaaatccttctcaagtcagtactccaacctcctgccctttaaagcgtgggcctttgaccaatggcattggcatcacttgggagcttataacaaatgcagaattacgcctgtaatcctagcactttgggaggccgagacgggtggatcacctgaggtcaggagttcgtgaccagcctggccaacatggtgaaaccccactctactaaaaacacaaaaaattagctggacatgattacagtagtgggctctgtaatcccagctactcgggaggctgaggcaggagaatcgcttgaacctgggaggcggaggttgcagtgagcagagatcgcaccattgcactccagcctgggcaacaagaacaaaactccatctcaaaaaaaaaaaaaaaaaaagcagaaccttggtggggcatggtggctcacacctgtaaatcccagtactttgggaggactgtttggggtcaggagttcaagaccagcctgggcaacatggcaaaaccctgtctctacaaaaaatacaacaattagccaggcgtggtggtatgtgcctgtagccccagctacttgggaggctgagacaggtagatggcttgagcccgggaggcagagattgcaatgagcggagatggtgccactgcattctagcctgggtgacagagccagaccctgtttcaaaaaaagaaaaagaaaaaaaaaaggcagaatctcaggttccatctcagaccaactgagtcaggatctgcactgaaatgggatctccaggtggctcgatgccggccaaagcctgaccgccttgaacaatgagtggcagagctggcacagcaagtgaaacccatatgtcatccctggcccagggaagctctaggaagcatctgatttagacccctactgatccttgcaggctggggttctgcctaggtcttgacagctctcttggagactgcgatgcttcagctgaaagacagttcagcaaagttcctgctgtcagatgaaccaccagcaggaatccatgcaacttacctgctctccaacagcccactgtcaaattccacgcgtctcctggcaccaagaggttcccgtctatcacctgacacacatgctctcaatcacctgtgatatcctcttcacttccaacttcttcctgggggtgtctgcccctccttctagataaaatcaatctccaacctgacccaaaattggcctgcctattcctcccactgaccagaccaatggttctagaccagcagcttcagcactgtttggaagtgtgttaagagatgcaaatcttcaatccctaccccagacctagtgatcagaactctgggggtggggcccagcaatctgtgtgtccaatggacacacaacctaggggattctgatgcacactaaaacttgagaaccacttggccaaagacaaaaaaataaagtcagtgtggccgggctcagtggctcacgcctgtaatcccagcactttgggaggctgaggcgggcagatcacctgaggtcaggagttcgagaccagcctggccaacatggtgaaaccctgtctctcctacaaggtggcacacgcctgtaatcccagctaactgggaggctgaggcgggagaatcacttgaacccgtgaggcggaggttgcagtgagctgcgatcacaccactgcactccagcctgggcaacaagagcaaaactccgtctcaaaaaaataaaaaaaataaaataagtcagtcacacccaaccacctcctcacactgcaatgacagttaatgggacatgaggaaggactccagtccctgctctgtccccaagttcaagacgtctggcaggagtgtgaatgtttcctgactataagaatatacatactataaaaacatacatatttcccgactataacaacgtccagcaggagtgtgaatgtttcctgaccacaagaacatacatatttagctggcactctaataacccaggtaaataaccagccaagttaagacaaaggccagcagtcacttaccctaccattacacatgatcaatgaattgtagtaaactccagcgccatagttattctggatggacgtgataatcttgggccctaaaacttttaggaaagagtagtgactccaatttttcttcaggttctttgaatgccatgcgacagggtcatctactgtgaacacaaagtccagcatagcattctgtggagtgaagaaaagagaataatttcagtattaattcctagaaaggcagcaagagagcatggaaaagctctaacatactacgcaattatgatcaatagtcagaaggcctggtgctgtcatcagaaatgtgagcgagtctctggaacaaatatgagctttgttttcatcaatgtaataatagcaaacacttctttaacatgtattgttgtgccagcactctttaaacactttatgggtaacatacgcagtcactccatttatcctcagcacaaccctacaaggtagctactgctattatctcaattttataagaaaccaaggcacaggggatgctctttgcccaaggacacagagcttgtgagtggcagacctaagaggtctggctccaaactgtgtgtgctgaaccactgcactacactgcctttcacaaatgtagctaaatgtgctccgcttttcttctggatcaaattagcaccacctggataaactctacaaaatactatataaaaggaagtcagttattttatctcttacctattcaccaaccacttattgagtacataagtaatgaactctgacaggccctagggtagaagtatagagctcagagtctactggagagaataaacaaattatcactacattgacttgatagaggaatgcaaaatgtactaactgcactcagcatagggatcagatcaggggcacaggagggagaaattctcctagagatgacaaatctgagtcttgaaggacacgtgagttaaacagacttgctggaagcactgggggaagcacagggaagggtagggagccgtgttggaggaaagtgctctgtggatatgggagccagcatgttctggaagctgccgtcagatatgactgaaatagaacacatttatgcggtgggagatgagatcagagagggaggctgtttgccatgctagaaaattttcctgcagaagagctgactggagagaagagggactaagggggtgggggaattagatctgaagccatggcaagattccaggggagaaatgaaattatattagctaaggcgctaaggatggggactgatgtgagaaagatgtaggtgttggaatctacaacttgttcacttgaatgtaaggaatcaaaagtgagggaatgggaaggaaggaccttttcttgcagggaattccaggtctattcaaaggaaaacctccatggaagaatgaagaggtggccatcaggaggctaacgcctgctctgtagagtgtgactctacagaccactggggacacttgagatttggtggcgaggcaggtatggaataaacatgttttttaaaaatgtgtaattatgttaaggtaaattcgggaaaaataactagcctataataacctataatttctcatatgctgccaatttaaagaaaaatattaaatagtagtgtaagtgggaaacagaggaaatccaagcaacagcatagatggcctcaccaggaagtgaacaggcaggatgttaatcagaagacagactacagtcaggtatccagacgcagggggccccattaaaacctgcacactgaattctgcaaattacaaggaaaactgtacccttactgaggctgtgctgagccaactctgaaaagtaacaatgcctagtctcaaacagaccgttgttaaaagtgctgagcgagggtaaatacactggtcacgcactaacttttgatgttagttactttcactgcacctgccctggccctacaaccagtccgccaacttcctgaagtcagaagatcattttgcattttctcctacatttatagaggtgactctcaacaaacttggctgcgcattagaatcacctgggacgtttcttaaattcctgaagcccaggcctcatcccaaaccaattaaatcagaatctccatcggcggaagccgagcattaggattttcttaaaagctccccagaaaattccgatgtccagccgactaaaacactgaaagaacctgataacgatttcttttcctttcttccatttgcccctgcagcagtttttccttctgcctaactgcttctcctgctctagacccacgtggattcctaagtatccttcaacaccgtcgcttcaactcgcgctgtcgttatactaggaaggcaggcctatggttcactctgctagtggacacgtggagtgtgcagagcggacaggcagctctccgactctgaaggaatcgagggcaaaacgggactcgtgagaacagacagttccccgtcgtggggctgcccgggctcaccttctggtctgaactcggccctgcctggcggtacaccccggagccgtagacgaaagccagactcagctcctcggggaagtgagacaggatcttgcggaaggtcacccacgagctctgcagcgtctgcagcgccatggggtcgaggctaacaggggacactcagcgcagcagggcgaggacaaccgggcggggaacagacaccgggtaggcggtttagggtgggaaatggaagtcggagactggatcgagggacacaaggctgagtgtggggtgggactgcaagcacacgcaaggattggggcgttgggccacgaagagcagcggcgagaagacgcagcccagataggctcgggtgggcggcggtcgcacaggcagagcttccgtcccttgctacgccccacgcacgcacaggcgcttccaagacgcaagaggcggtgctcgccttagtgtggggaacgcgaggctttgcattgtcccctcgtggtcggaggagtgccctacaggctggcggctaggttgcgacttggacaaatcggcggaggcgagcgtcacccgactccgcgggccctgagccttgatagcctctgtacttctctcttcaaactacggtttaaagaatgactataaaatcgggagcgtattgaaggtttttaagtgaggcgacactcacataatatggaactagccgttctgaaatggacagtgtagtagcatgtagtgccttcacaatattgtgcccccatcatcgctctagttccaaaattgcagatttcgaagatttggaaaaacacaaaattaaaatgatgcccaatcccgccatgtagagaataccaccgtcaagatttgacggagacttcttcacgctaaagcccttttcaaatacaagggtggatatgggagtgcacagacgttctctgatacttgcatttaatttcaagggtggatcacagtttttgcccccttgccttgtggaatggtctcacaaagggtgcttcaaatgcagtttctggaggaaacaggaccctaggagtagaaaaatcttacagctctcctctttgtataactggagaaacttgctgaagattaccattcaggaggtggtttgacttccaggacagaaactttttcaactaccctctccttcctccccaaaatacactacctctcaaaaataatagaaatagtaatagctaacattcaggtaatgttgacacattttcacatgcacttctcactgagcaccctctagtgccctgtggcaggagggccttggttttactgatggccaagctaaggcttagagaggtaaagccaggtgataggatcacatcagcctgtggcaaaactagagctaaacccaggtctggctccaactctgggattttttcggaaattctgctctgtccttgaagggttttgagcaaggacttatgtaattcacatgttagcctgaattgtgggggactgattagacagttgttatcatagttcccccatgaactggaaacggctaggccaaggtcttaggagcagggatgggattaaatcaattggaaaaatgattacttgcactcacactctgggcctgcactgagatgaagagatctgagctgcctgctgccctgcaggagctaggggtctgtagaggagaggagacagaactgcaaatcagagtagaatttgggtaatgcagccaggtacccagcacagtgccggaatgtaatgtccctccaatgggaacgtcagtcagttctgggtgttggggaaagggaccagaagaggtttcacaatgatggcattttgagccaggcctggaagctgggtaggagtttatcaggtagaagatagatgggaaaattcaaccaagaaagaattgaaaggactcggtgacaataatactaataataggtgtcattattaagcacttagtatgcccaggcactttttagacttctttggggcttttctgtttttgttttttttttgagaccgagtcttgctctgttgcccaggctggagtgcagtggcacgatctcagctcactgtgacctctgcctcctgggttcaagcaagcatgcctggctaattgttgtatttttagtagagatggggtttcactgtgttggccaggctggtctcgaaatcctgacctctagtgatttgcccacctcagcctcccaaagtgctggaattacaggcgtgagccactgcacccaggctttttatacttgtttcttttcatcactccagagatcctatgaggcaggttctctaagatgatgatatttttcatacgaggaaacagaggtcctaagaggagcagtaaatgttccaaagtcacacaggaaagtggtgaagtcggggtttgaacctagggctacctacctctaaaggccaaggtctttaccaccatgtttaagtgtcctctacagcggcttgcagggtgagagaaggaaatgggaagaaagcaggcactcaggcatcagccaagagtcaggagcagcagcagtagccgcagcaacaagcaggagaccagggcaagggagcggagagaggccgtttgtctgcggcccctggtgtgggcatggtcacttccgttcatttttactacatatcgcccttgcccagggtgccggaatcagagtgcactcaccgtggaattacactgaagcctctcacccaaagacagtgaataaatctcattaccagccggttccttttttatttccttccttcccttggggaaataattcaacgtcattggatttttcctgtttgcaaaagtaatccatgttcataaaaatgtaaacattatgaaatacatacatcatgccccagaaatagccacggtaatctttggcacatattccttccaatatttttctatgaatatattaacattaaaaacaattttaagtggattcctaggatagatactattttgcaatttgctttttttgcacttagcgtatcagggacaatgttctgtgtcagaatatatagatttccctcattccatgtattagtagcaaattattctaagatatggatatgccataattttgtttaaaattttttgtttaaaagaaagtgtttaaacattttctttctctttctttctttcttcttttcttttgtttctttctttttttttttttttttttgagagcgagtcttgctctgtcacccaggctggagtgcagtggcacaatctaggctccctgcaacctccaccatccgggttgaagtgattctcctgcctcagcctcctgagtagctgggattacaggtgcccgccaccacatctggctaagttttgtatttttcgtagagacaggggtttcactatgttggccaggctggtctcgaactcctgacctcaagtgatccacccgcctcggcctcccaaagtgctggggttacaggcatcctggcctgtttaaacattttattgttgatggatgtaggttatttctagttttcacacctgcaaacaatgctatcatgagcatccttgtacattttatgtgcatgaacaagtattgctataagacagattcctagaaggggaattgctgggtcagagtgtcagcacgctgctaaattcccctccaaaagatggtgccaattcacacacccaccagcagagttcagcccttgatagaaataaagatgctgcaatgtttctccatttgtctcccttacaggcgttcacacccaattatcagcaattttcatgttcacaaacacttttcttcctgcaatgcaaaaccaccagctggaaggttccatcacattcctgtgtgcattttgcctttccccagaaagaggcagaagcaacgtagccacgaacacatttgtattcttcagcagaaatctccctgctcctggcccttcatccacccactctcttttaaattaccatggcttgtgaaattagaggctattaggaagacccagtgttctatataatcgctttagggttctgttggaaagcttataccaatgaaataaacatgttagagagccacttacaaatatagataaatgcctggtgactcgagtgaatattgggcctcattcttctgatttatctagcagttgtctttgtattccttaataatgaccttgtcaggctttcactaggagaaggttcatcgaatccatgtaatccattttttttaaagccctgtaaaaaaacatctatggctttaatgctttttttttttttttctaatcagtgtttaagtacaggagagaaaaatgtttggggaagaataaaaatccaggctcagtggttcttacaattagccacatgttcaattggtctgctgatggaggggaaggagaggggtcttgatctccatcttgtcagaggtgggtcaccctgtcccatttgtccattctcggctgattgatggttagaactgggacagactgggagcattttttcgttttttcttttcttttctttcttttcttttctttttttcttttcttttcttttttttttttttttttttttgagacagggtttcactctgtcacccaggctggagtgcagtggcacgatctcggctcactgtaacctctgcctcccaggctcgagtgatcctcccacctcagcctcctgagtagctgggattacaggcatgtactaccacaccaggctaatttttgtatttttgtagagaatggggtttcaccatgttgtccaggctggtcttgaacccttgagctcgaacaatccacccacctaggcctcccaaagtgctggaattacaggcgtgagccactatgcccagccaactgagagcatcttaatacatctttagtgtctgatcaggggcttgaaggtaccacctgggttggaatccaggccccaggatttaatagctgtgtgaccttggacaagaagacttagcctctctgtgctttcctttcctcatctgcagcctggggagagtaatgacacctcactcacagggttgttgtgacagcaaatgaaacagtatctagaaagtacatagaatagtgcctggagtaagctttcaataaacggaggacatcctcctgaattcttaagagacaatgtacaaaaggaattaagaagcataattatacctacatctttatggcgtttagcattttacacaaagcactttgcagacatgattttatttagctcttaaaacaaatcctgggaaattagtagctactatttcagttttacagatggataaactgaagcttagaaaaaagaattgatgtgcctgaagtcacagggctaatggcagctgctaatacagcctccaagtccaatccctttcctcttgcacgagaaaaataacacggggtgttcatttcaccaagggacccattcattcattgattcattctcccattgaaaccttcctcatcctttagtcccagctcagctatcaaagtgttctgttctctgtgccttcctaaccctttgcttttagctctctagctcttgtcttaaatatcagatatgtccatcaagtacaattataaaaggcttaggggccctttgaggtcaggaaccatatcttattaatctttctgtcctttagtgcctagtacagtgcctgaaacaaaatttctgcatttgcaaatgttatagtctggtggcaaaaaattcacatgcatgcaaaaaaaaatacactatggagagtataaaccagatctataccaccgcaatggtaagacagcaggggttactttttcttcagggtttctgggaaagcttcttagagggatgacatttggattagaccttggaagatgaccagcagttcaccagagagtacaccgtgaaaaaattctaagaagaaagaattgcctccatactgggtcttagaatcctccttctagggggacactgagttttccagtggagttcaggaagaccatggacttttacagtaccaaagaaatgaataaataatggtggaattccaaagaacagagcaggtatctcatctgagaggcagaatgtggaatctggattgagactgcttggtttcaattctcagccactgatgatctgtgtgacctggtgcaagttggctctgtgtctcagtttccacaagtataaaatggggataataagagcgtctacctcccagagttgtcatgacaactaagctggttagatcaatctctgacatgtagtgagtactacgtatgtgtttacccttctgattctccactatccctgaaattcaagctggtcagcagctgcccactttatctctctgtagaactggccctgaattttgggagaaactgaattggcaaagaactgagttagaagagaaagaattagttaccatataccaagtctgtctctggcatgaacccctgcgatctgggtttggtgtaaagcagcttgtcccaaggagggttatttgataaaaaattctatcagctaagtttgggaaattctggattaaacagaggcaaatcgagatctttgatgtgggattcctccgagcattaatatattaataagcattgtgaatctccaagagagaagcagaacatgtagcattttccaatctcccagactaggttttcctccatcctctgctccctccaccttctctctcagtgtcttctgggattcatattctgtggcataaatttaggaagcgctggtgccaagcactcccttgctgtcccagaatcatctcagtgtcccaaaccaatcaagactaattttcacggacctcttttgcctgaaggcaccaggggatcctatagcctaagagagagattggggaatttctcaacacatgaattacggtt

SEQ ID NO: 179 - DNA, 3040 bp, Homo sapiens
tgctttaaattcgataattcaggaacacacttaaaacataaagcaagcatttctgtcctctatatgtttcttaaatgatctctagaaaaatcatgtaagtccaaactaagttattattactttttggaacagaatgtatagcgtgtagactgaaactagattataggatatgatttctttagtttacactcaaactttgtgctccttttaaaaacatttttatcttcttcaaatgaaaacacagacatctttgccaagtccctatttttaaaagttggggtaaaatatgcataacataaaattgactgttttaatcattttaacgtgtattattcagtagcaataagtacattaacattgttatgcaaccatcttcattatctatctccaaaacgttgtcattccaaacagaaactctgcactcattaaaaaaaggatagttctcacctcattcccacctcctctggcctctggtaacctctattctactttttgtctgtatgaatttgtctattcttggtacctcatataagtggaatcacacactatttgtccttttgtgtctggcttatttcacttagcataatattttcaaggttcatccatgttgtaacatataacagaatttcattcctttcgaagcccgaataacattctattgtatgtatataccacattttgtttatctattcatctgtttatcaacatttcggttgtttatccattttggctattgtaataatgcttcccataaacattgatatacatatatttatttgaatccctgttttcaatttttttgggtatatacctagatgtaggagaagtgctggatgatatggtaattctacattcagctttatatatatatatataaagctatatatgcatatacatagttatatacgtgtacatagatacacacacacacaactttttaaaaagttatttacttttttaagtaaccaccaaactattcagtgcaacggttgtaccattttgtatccccaccagctatgcataaggctttcaattttccacatctttgagaacacttgttattttccttttatttttaaaatagccatcctaatgggtgtaaagttctggggtgttttccaaaactaacaaccagttctccaattcttcagacaccaatttggatgtccaacaattcaagtcaattctgacactgcctgaaattgcatcacattccacagataaatgggttcagtacccacttcagatgccaattgcaagtcccaggccatcggtaattctgaccaaccaactacaaatggtaggttcccatgacgcccctcctcatgttcaacagtttgctagaatggcttacagaactcagggaaacactttacttatgtttactagtttattataacttaggaacagcccgctggaagagatgcacagggcagagcatggggagtgtagtgcagaacttccatgccctactgggcgttatcaccttcccagcaagttaatgtgttcaccaaacagaaaactctctaaatctcactgttcaagagtttttacagagctccatctccagggcctgccctcccctcttcccaggggtcagtaggtgggactgaaagtctcaaccctctaattacttggtctttctggggaccagctccatcctgaggctctttaggggccccactctaaaaaaccttatgaacataaactcaggtgtgattgaaaagggttcattataaataacaaaagacactcctttcacttagaaaattccaagagtcttaggagccctgtgccaggaaccagagataaagaccaatatatttttgcattataccacaaaattggtacctcctggtggttttgatttgcatttacccaacgactattgatttggggcattttctctttttttttttttttttgagacagggtctcactctgtcacccaggctagaatgcagtggtgtgatcatggctcaccataacttcaacttcttgggctcaagcgatgctcctgcttcagcctcctaaatagccaggactacacatgtgtgccaccatgcctggctaatttttagaaaatttttgtagagatcgtgtctcactacgtttcccaggctagtcttgaactcctggactcaagcaatcctcccacgtcagcctcccaaagtgttgggattacaggcatgaaccactgtgcccagccagcatctttttattcattggccatttctatatctttggagaaatgtttattcaagtcctttgcccattctttaaaccgggttgccagttcttctattgttgagtcactggagttctttatatattctggatattaatcccttatcagatatatgatttgcaaatattttatcatattccttgggctgcttcttcattttcttgatgtgttctttgatgcacagagaatttttaatattgagagagtccaatttgtctatttttttctcttgttgactgtgctttcgttgtcattccaagaaatcattgccaaatccagtgtcatgaaggattttctgtgttcttctaagagttttatagttttagctcttttgtttagatatttgctcccattttgagttactttttgtatgtaatataaggtaagggttcaccatcattcttttgcatgtggatatccagttttcccagaaccatttgttgaaaagactgtcctttctccattgaatggcattggcgcacttgttgaaagtcatttgatgatatatgtaagagtttatttttgtcatggaaataggtcctataatccttttgcaggtatataaaagatacttcttaacaatataaatatacataacacagaaaggctatgccagaggggctatcataaataataaaagcatattgtaacaaaagaagaaaaacaaataccacccaaaattatttaaagcacatttttattatagataggttaagtgtggtttgctgtggctaaagatatatttataatggatgaacaagcttttctagataccaagaggtataatatttt

SEQ ID NO: 180 - DNA, 5204 bp, Homo sapiens
ctggcttgctcaaattatgttcacatttctaaaaagaaaacaaatataacacgtatcagaagacaacaacacactttgttgatccatagagctgctaaattcagaaggacagcatttacgagaattttgttttgttttgttctgctataagaccatatgtttttgaataatgtatagcagccaaagtttataaaagatgttcgcacttcctgatatgtgcaaccccactatccaatattattatacctctgtggtacttaaaaactactaaaataacacatactgagtacatactgtatttgctaaacaacgtgctcactggtttaactggatttaaatatcacatcaactttatgagctaggtataggtattacattaaggttgccatattatagatgatcaaaatggtatacaggaagggtaagtaacctgtccaacttcacagagccaataaaaatggacactgggatttaaatctaggtagtaaaattccagatcctatgctttaaagtacagtaacaatgattacttttgagatagggtatcactctgttacccaggctggagtgcagtggcacaatcaaagctcactacagcctccaactcctgggctcaagtaatcttcctgccttggcctcccaaagtgctgggattacaggcatgagccactgcactaggacagtaataattatttactactttcttaaatacatactacatatacctggttaaaaatttttttaacagaacaaaaaaggtgtccagtgtaaagattacccattatctgtctgtccccttgttttctccagatagcctatgcacataaaagtacaagcatacatcaccttgcttttttcacaataacacaaaagggaacattttatatttattctcttgcttttttcatttattctatcttggaattaattccatttcagtacatatagagaggcctctgtgtcccactgtaacaatttctataacttacataagatagaaattgatggacattcaggatgtttccattattttgctactgtaagtaatgcagcgatgagtgttcttgtacatgaatcatttcctaagtgtctaagtatctgtaagacaatttcctaagagtagatcaaagggtgtatgcatttgctattttaatggatactgaaatataactgactaatctgacgattatgaaatgatattccactgcagttaattttttttaatttttcattttctcattgcagttttaatgtacatttccctgattagtgtataaatttgaatatctttcatatttattggctattgggatttcctctgccataacttgaatgttaggatctactggttatttttatttccttgccgatttgctgatattaacaatagattttaatctcttgttaataatataccttgcaaactacttttctcagtctgtggcttatcttttcatttctttatgggttttctttggcatgagggtacaagttttacttttaatgaagtaaaatatgtaactttacattacagtttgtgcttatttgtattacttatgaaacatttccctacccagaagtcatgaaggtattctcctctatttccttctagaagtttggctcttcagatttccaatgttcctgaaattaacttctatgtagggtgaggtagcaacccaattttattttcttccatataatcacttgacctagcaaaatataattgcctattctttccccaatgatctacaatgccatatttagtatataacaaattttctcatatgcatgggtctacgtctgcatacatatagacacacttttttttgtttatatgtacatttgtactttccctccttttttatacagaaaaagtgcatacctaccatgcactttgctttttgcatttaaaaatgtatcccaggctgggcgcagtggctcacgcctgtaatcccagcactttgggaggctgaggcgggcggaccacgaggtcaggagattgagaccatcctggctaacacggtgaaaccccatctctactaaaagtacaaaaaaattagccaggcgtagtggcgggcgcctgtagtcccagctacacgggaggctgaggcaggagaatggcgtgaacctgggaggtggagcttgcagtgagccgagatcacgccgctgcactccagcatgagcaacagagtgagactccgtctcaaaaaaaaaaaaaaaaaaaaaaagtatcccatattaacacattcttttataaatttatagtactcattctgcggatatactataatctctgcatattttggtttgtatttgtggaggtgcaaggtagattcctaaaagtgaagttgatgagacaaaaggtaactttacttttggtaggtattactatattaatggtgcattatataaccatatttatataaatttatatcaatttaatttatatataactatttccattactaatcttttttaagaaatcaacttctgattctgttgcccttttgtattttggtttcttaatttactgtattttatattaatttattgtattttattttggtttcttaatttattaacacctgttctctttggactttgctgttttttttctaacttcttgaaatggatgctgacatcgctaatcttttaatatttcttcttttctaatatatactgtatagctaagcacagccttagttgtatcctgcaagttttgctataaagaaattactgattcctaacttaactacgttgtgatcaaataatatactttaataatttcatcttccagctgacagcctcagcaagagaaagcatagggactccaatggcagcagcagcatgtgcaaagaaacaatcatgaaagttggtagacaatattggatgggtgccccaggtctctccaagctggctatttattatattttgttatttaaaacaaacctgtatttatttattttttgagacaagttttgctcttgttgcccaggccggagtacaatggcgcaatcttggctcactgcaacctccgcctcctgggtacaaccaattctcctgcctcagcctcccaacaaacctatattttaagcagaattaaaaaaaaaataagctggtataaggctatatgacttttgatcaaaccaacgagatgcagggcttctaaatataagggatcatctgaaatgaatgttgtttgaaataactgtctaattttgagagttccagtatttatgtgaaaatttaacaatttttaaagaagtccttggaaattggtattgacagtaaatctccttaaaatagaattttaaagctttcaacacactggaactctccccagctttggaccaaccccacaactgagcggagccacctcctcgagacatgcattgctctgctgctggatactctaacagcttgaacaggggagctcacttaagaagagatattgtgtagtttaaaacatattagtttgtataaaataacttctcataaatttctcataaattaaagctgcagtacaattcacttagtggttaggccaatcctccccgccattatccttgctttgttataaatcaccattaaaaaccattataatgtttttaatagtatcagctggcacttaaatatttttggagtgaaaattattcctaaagttatacatgactcccacaaaaatacagttttatcatattaaagagacctgtactgatttgccaaaattccgcaacttagcaaaggtattaccttccttggatttgtactttgtgatacagtgtgctgtaccgtgggctggttatgttaactgaaaaaatagtcattacccaagttttgcagcactctaaacttaagcagaagaacagctgttcacatcttacaaatgccatgtgtcaaaatcatggttttgtaattgctaaggtacggtatgtcaggttatttgaaaacaattactttttgaagtaattgtgaccacaaagcatcatttttacatgaaaagttgtctgtcatttgaaattatgcaaatgatgtcttgacctgaagcacaaaccccaggtacttaatgtttttaataatatggtgccactgcaggggttaggggcggtggggaagaacaaggataatggcggggaggattggcctaactaaccactaagtgaattgtactgcagctttgatttatgagacatccttatctgggatatttgagggcagctgcaaactaaaaacaatccagtaaatgtactttgtttatattttgtatcaggcaattatcaactgctaaataatagctttcatatttgcaactgttgcatacagagtacttttgctaaaaggtgattagctcttgcctttaattttacagtgcttaatgtgataaacttccagacatgtttcctataaaagagaccatttaatatatgtatataaaccacagtaatagtataacatactattttaaaattatttttttctacttaaaatatttaattttaggcttcttaggacatttctaaagcagattaaacccaataagcaggccgggcgcggtggctcacgcctgtaatcccagcattttgggaggccgaggcgggcggatcacgaggtcagaagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaacaaaaaacccaataagcttcctgatgatttttttgtaattggagatagttttctcaactgaaataacatttcagctaaataaagcattttaaaatattgatatttgataaaaaattgccttgtataatttctgtaaattatatttgttctgaaaaaggtataatgccctaatgttaaaagattttaaacaaatccttatcctttgatttttaaaactctgatctaatgataaaattctataaattttcattttcccgtgcagttaggtagcaaaatagctggtaattcataacttttacctattaaaatataaacacacaacaagcaaatgtatttaagagtactaaatggaaataaag

SEQ ID NO: 181 - DNA, 2134 bp, Homo sapiens
ttccctccttttttatacagaaaaagtgcatacctaccatgcactttgctttttgcatttaaaaatgtatcccaggctgggcgcagtggctcacgcctgtaatcccagcactttgggaggctgaggcgggcggaccacgaggtcaggagattgagaccatcctggctaacacggtgaaaccccatctctactaaaagtacaaaaaaattagccaggcgtagtggcgggcgcctgtagtcccagctacacgggaggctgaggcaggagaatggcgtgaacctgggaggtggagcttgcagtgagccgagatcacgccgctgcactccagcatgagcaacagagtgagactccgtctcaaaaaaaaaaaaaaaaaaaaaaagtatcccatattaacacattcttttataaatttatagtactcattctgcggatatactataatctctgcatattttggtttgtatttgtggaggtgcaaggtagattcctaaaagtgaagttgatgagacaaaaggtaactttacttttggtaggtattactatattaatggtgcattatataaccatatttatataaatttatatcaatttaatttatatataactatttccattactaatcttttttaagaaatcaacttctgattctgttgcccttttgtattttggtttcttaatttactgtattttatattaatttattgtattttattttggtttcttaatttattaacacctgttctctttggactttgctgttttttttctaacttcttgaaatggatgctgacatcgctaatcttttaatatttcttcttttctaatatatactgtatagctaagcacagccttagttgtatcctgcaagttttgctataaagaaattactgattcctaacttaactacgttgtgatcaaataatatactttaataatttcatcttccagctgacagcctcagcaagagaaagcatagggactccaatggcagcagcagcatgtgcaaagaaacaatcatgaaagttggtagacaatattggatgggtgccccaggtctctccaagctggctatttattatattttgttatttaaaacaaacctgtatttatttattttttgagacaagttttgctcttgttgcccaggccggagtacaatggcgcaatcttggctcactgcaacctccgcctcctgggtacaaccaattctcctgcctcagcctcccaacaaacctatattttaagcagaattaaaaaaaaaataagctggtataaggctatatgacttttgatcaaaccaacgagatgcagggcttctaaatataagggatcatctgaaatgaatgttgtttgaaataactgtctaattttgagagttccagtatttatgtgaaaatttaacaatttttaaagaagtccttggaaattggtattgacagtaaatctccttaaaatagaattttaaagctttcaacacactggaactctccccagctttggaccaaccccacaactgagcggagccacctcctcgagacatgcattgctctgctgctggatactctaacagcttgaacaggggagctcacttaagaagagatattgtgtagtttaaaacatattagtttgtataaaataacttctcataaatttctcataaattaaagctgcagtacaattcacttagtggttaggccaatcctccccgccattatccttgctttgttataaatcaccattaaaaaccattataatgtttttaatagtatcagctggcacttaaatatttttggagtgaaaattattcctaaagttatacatgactcccacaaaaatacagttttatcatattaaagagacctgtactgatttgccaaaattccgcaacttagcaaaggtattaccttccttggatttgtactttgtgatacagtgtgctgtaccgtgggctggttatgttaactgaaaaaatagtcattacccaagttttgcagcactctaaacttaagcagaagaacagctgttcacatcttacaaatgccatgtgtcaaaatcatggttttgtaattgctaaggtacggtatgtcaggttatttgaaaacaattactttttgaagtaattgtgaccacaaag

SEQ ID NO: 182 - DNA, 5688 bp, Homo sapiens
atgccagaatgtaaaatcacaataatgagccatagtctactatgattcttggcctactgtaagctgcaataaatgttttaaatgaataagtgagtttacaagggaagaaaattaatataagttacataaaatttttattaatttaacaattgtaagtcatgatagttaacaggtgaaatgaatgtcttattacttattgaaataaaaattaacaaaagtagttaaaagtgcttgtgttaaacaagcttaaattattctaacacattaattaaatttcaataggcagacattttcaagctggagaagcttgaaaggtagtcagggagaaaggtagtccgtcatttaccaaaggtcacacactctggagggagatttccagcatgcaccggggccattttgtgttgagcttcacagtaaggagcagagatgaagcgtgcagatgctggagtcagactacctgggtttccatttctactttgctatttattagctgtgtagaattagatgaactatttaacctttgtcttcctcagttatttccttcataaaataaggctaaccatataatttttgtgagaattaaatgcatcaacatgggtcaagtgtctccaactggatgtacaggacattctaagaactttttttaggatattaccatagctgtgaccgcttctcgactcaaaacatggaataagggctaaatgcctcttctcctgagaagagtccaaaataatacaaagagtattcatggacgctagttggttttatttctttgatttacttattcttttgttaccaaggctgatgaaaagtgacttttcattaaaaacaccgctaccaaccactactgtcttgcatcacaaccaccaccattgcaactaccatcaccaccattaccacgagttttaccactatttccaccatcacggtagcagctattacccccaccaccatcataaccatcaccacctctgcaatagcatcaccaccatcactatcaccattatcatcactatcaccatcaccatcattaaaaacaacatttttaacatccatgtgaatagaataatgtgaatttagaagtgtcatttggagagtgaaggatcacagaaaagatgtatgtgtacacatactggtgaagggaggaaaaagatttagtgttcaggcagctaaaggaatacaccagaaacaaagatgaagtaatgtttatgtgttatacacaacgtttgagccagtagtttcagagtaaaaccattacaaaggtaaaatgaaaaattccttcttacatgctaatctgtgctgtttgaaatctgtaactaaggttgtttacagtagtggttgagagaatgggctttaattaaagagtcttggattttagttccatatctacttcatacctgcccttgagtatgctatttaacctcccagaacttgtattttctccatctaaaaaatggtggttccattatttagaatttgtgtgaatatttaatacatactcacatataacataagcattcagcacaatgcttgtgcaagattaagaccttcccctgttgccctctaatcagtttctctccaaattttaactactcagtaaatcacactatcattcttaggtaagagttgacttcaattcagccctttctctcctccacctcctgcacccccaggaactcattaataaatttttcctgttctacctctggaatatagcttacattcatccactttgattttacttccctgctgccatctttgcccaagcccagagtactaggatagaccaatctctcagttgctgctcaatacaatcaatcctccacagagcagccaatgtgaacttaaaaaaatgtaaatcagatgatgcttaaagttttcagtagtttcctattgtacttagaatcaaaatttagctctttaccgtcaattttttttctacatgatttgttctctgtctaccttttctacttaaactcttaccattctcccctaattctagaagctttggtcacaccaccctccttagtgtcttttttttgggggggatggaatttcactctgtcacccgggctgaagtgcggtggcacaatctcagctcactgcaacctccgcctcccgggttcaagtgattctcctgcctcagcctcctgagtagctgggactacaggtgcgtgtcaccaagcccagctaagttttttttttattttttttaattttatactaagcttttggctatgtcctttcaaagaggtctcccttatctcaagtagtatttattctccacacctaatccagcttcttatcatcatttcaccttattttttaataactctcacagtctgaagttatatttatcatgtagttgtttatttattcggtcctctattataggaatgtaagtaacttgaaggaaattacactgttggtcttgttcatgtgtctactcccagtgccaaaagcagttcctagcatgtttttgaaatgcaataaaatattcactatgcaaatgaaaactgatttttttttgagaggggcagtgtctgccttaaataatacctcattctggaaaacacaattaattatggtagaaactggagagaaatttttttcttatggagaagaaagccctcaaatccccaaatggaggcatagaaaagctgagaaataagttcacatataagcttaggtctgcatttcttgcaaataatattctaataatgtgctctgaaataaacaaaaaagtttcagataaacttttattaatattttgtttagctccatagtttataattgatctatggtttataattgatctatttaaaagatctatttatacttaggctaacacaaacattcaagagctaaatcattgccaagggtatataatgtctacaacctaaatgtagtggctctgacacacacataacaacaacaacaaaaagactatttgctgataggttgaaaagaaataaagaaaaaaatcagttattgtggttatttagtcaaagaggaaagcaaaactgagattgacatagcatatcaactactctgtactcactgtgcatggggtctgcatccatggctccccatcaatttgcattggcagagacttgctcgtcctgggggaaaatatttcattgtaagtattgcaaggaaatactttatattacagactatatgtgagatataagatgatgagaccagggaaggcaatatggtaatagttgggctctaaatttatctccaatgaaaggagcttcaactctccactattaataaataccctgaaaagtaccttagtcacaggaatattatgagcttcctggtaagtgtagtgacatttaaaaaaattctggatgccaaaagaaaaatttcagggtttatgtttaatgacacgatcagaatttctacagccaaaagagattccttgtttttataaccctacattgcaaactgggagaaaggtgtttctcccagttcttctagcaccaacacttccagataaataacatcaattattcctgtgctacaatccgtggcttcacctgggcagatcacgaggtcagtagtttgaaaccagcctgaccaacatggtgaaaccccatctgtactaaaaatacaaaaattagccaggatgtgttggcgggtgcctgtaatcccagatactcgggaggatgaggcagaagaatccttgaaactggaaggtggggttgcagtgagccaagatcgtgccactgcactccagcctgggcaacaagagtgaaactccgtctcaaaaaaaaaaaaaaaaaaaaaaaaaattggggggaaattttgggcaaaaaaaatgcttgaaaaagttaaaatttaaaacatatataaaatcttactgtggcactttagtccatgaaatgatttaagtcaatggtgtctcatcattgttttcatagataatttgcccagtaaatactttggtgcttcagtagactaatatgagtataaatcataaaatttgtatgtttgaattcgtgcatcaatatgtccatggtagtcaacaagagagaatcagattccaacaaaccatatcagtaatagctaaccaatattttagacaatctgccaatgtccattattttgaaatatattagtattaataactgattatttggagcccaaagaagacaatgttactatcagagttctgcatacttttaattagtttgaggctatgccatatcaaacgcctttgtcagttacagaaagggaactacctgatgaccacgcaggagcactgagccagccgccggccagcacttttcaggcctgtgtatatttgccccatctccatggctccttccaagccgaccacctccagcagctggtcactgagatctgaaagaaagtagatgccttttaagttgcaatgtgtatacatatgtccacaatttaatgccatttgatattatggagattaaaaaaaataacagccacttcacaaagaaagcttgtcttagaaacttaaagtaataaaaagatggcctacttttataactctcagtttaactaaaccttgaggttctgtggaaaatgatttgctgtcagcttattctaaaacaaaatgggaagcacagattctgagccaaataataccaaaaaaaaaaaaaaaaaacccagtagtttttaacatcaacaaacttaatgttattccacatgtatataaggaccatttatacatcccacatcagacatttggcagcaaatacacatttcaacactataaataaaatatgaggatatgctgtcaaacatgattttgttaaattacttgaacaagagaccttggagatcatggagttggagcttctcattttatacattagaagatgggagtccctaaatctttgagtaacttgtctgtagtaataggtaactgtacagaagttcaagaaacaatagtaattttgtgaaatgtttttccgatgttaaggaatattctacaaaatactgtttggtagtatactagataattagtcccatgcaatcattattattaaatttttttttagcagaagacattaaaaaggggctaatagttaagagttgtcgcttgttgagtatttactaggactaattactttatattatctcatttgctcctgctccagaccaatttaagataaatgtgattctcctcatttacagatagagaagctaaacattggagatgttaataattattcatattcacatacctagaaagtgacagagccaaaaagtgaacctaattgctttgatgcactatgctacatttgataaatcaatcatatgaaaaggacagaatttacaacgttttagaaatcatcttaacataaaggtggaggttggactgcgtgagcttcaaggttcctttccaatctgaatatttgcattcagccagaaagcagaagttgaactcacatcaatagaatcccacacagtcctgtcccaagactcagtgacagcccatctgctcacctatttaactcagagtgctgagacccttgatttggaggccaaagtctaggtgcatatatatggttcttttccattgtaatattcttatgtgtttttgtgtattttcaaatataaatacacaattgtacattgtttagtagcagaaaaactagaggagtggaatacggtgggaggcatgattattatacaaga

SEQ ID NO: 183 - DNA, 4158 bp, Homo sapiens
tcaccatactgaacacaaacaattgagaacgtaaggatcacataattttgtcttttctgtatgtaatgtataaatcgagtatgaatgtacacatataatttgtatttagcatcacgtttttgaaggaatatgctactgtactaaaattatttttgtttggaaaaatgagtaatattttccattttcttttcatgaaatattgttaactgaacacttaaagctgtatcatgtatttatcacatggaatacggttaaatgaatatttaaagctgtatcatgtatttatttccatgaaatattattaactgaatattaaagctgtatcacatatttaattgtgtcacagttttacatttaaatagcttaaagcttatataaaagaaatatgggcatatattcaatctatacattgaagaactaatcaactcttccttaagtccaatagcagccaaatttgagaggtaaaatatatatttttggaatgatttatagagtgcactgaagaagaagataaaatgtcaaagaccttttattattattacttgataaaaagaaaattgtagaacaggacttaattctttaaaactattcttttttaaaaagtttgaggctcacaacaaaattgagactgtacagagattgaacactgctttatatctttccttcattttcttcactcaagtcttgcttacttcaaatatctctctgtgtttcacattaattctacttctgtttataaagttattacccactacacatgcatattcctccccactaccaacattctccaccaaagtagtacgttagttacaactggttaaactacattgacacctcattactatccaatctctataatatacattagggttctctttttgttgtatattctatgagtttggacaggtgtataatgaagtgtctaccattatagtgtctttcagagaagtttcactgccctaaaatatttctactctgtttatttatctctgccctcccaacaatctctgaacctttcattttctcccggattttgcctttcccatagtgtcatagagctgaaatcatacagactggctatttagactggcttttttctgttattaatatgcatttacatttcctccatgtcttcttatggcctgatagctcatttctttttatcactgaataacattgcattgtctggatgtactacagtttatgcattcatcaacttgattaaattttgaggtgtttaattaataaaaaagcttggccaggcaccggaactcatgcctgcaatcccagcactttgggaagccgaggtgggaggatcacaaggtgaagagatcgagaacatcctggccaacatggtgaaacctcgtctctactaaaaatacaaaaattagctgggcgcggtggtacatgcttgtagtcccagatacttgggaggttgaggcaggagaatcgctggaacccaggaggtggaggttgcagtgagccaagatcatgccactgcactccagcctgggcggcagagtgaaactgtctcaaaaataaataaataaataaataaaaataaaaaaactcacagatttattcctgctcctaccacctccccaagatcagcccactttttttaaatgtttctttatattatattttcatttagttttctgaaagcagaccctggtcctcaatctatctccacaggagttatttttacaccctactctaccctttatttatttatttatttatttattcatttttttttcttttgccctttccctaaatctggctgaagctcactacttatcttcctcgattgcagttcactaccctgaaaaaagtcctttttccttttaagaagtttgcactaatctaatggttattcagaagcttaggagacaacatgtacggcaaccaaaaagttgcaagcctgacttcttgactacagctgagatggtaaaatgataacatgaaatagtaagtgagatcctttctagcagcaatagcctctggtgaggaagctcaaaattctatttttaattaacaaaggccaattttacacacccagtcatcagtgaaattctctctttacaactaaaatgaaacataaagctgggcaaaacaaaagggtttgtttgttttttggcctcaagtgatcagagctaaatattgcttcagagtaaatattgcaattgacacttaaagtagtataatctgcagattcttctacttgccctaggctatactactttaaatatttcatcacaaaagtgaagcaaatgtgtgtgtgtgtatatatatgtgtgtgtgtgtgtatatacacatacacacacatatatatgtgtatgtatatactacaatagtacaaaataaagtgaaaagtaagcattgtaattagagcgtattagtcttttaggaataattatcttgtacttagcatttatttctgttaaaataagttcattatatatacacatacatacatacacacatacacattcttttcttcaaagctttagttataaaaagtagttagcattagtcatatcgaatgttgcctatgattatcacatttctaagcacatgattttcattatactccaatctagacacttcatttcttgaaacaataacctcaaaagttgtatttaatagataattttaattccagcttcaggttcaattattagcagataagttttgggtagctgttaaattagtgcctctggtccagtttgtttcattttcaaacacttgcatttcatataatgtaaacagtgacattttctctatttcttaatgaaatagtcaaaaacaataacatggatcacatttctaaatttataaggcaatacaacactggcaatttagctttttcttttaaaatattggttcaatttacagaaacgtatcagatttatttatcacatagtataattatatttccaacatccatactattggtcataatgagtagcatagataatcagaataaaaatagttgatattagtattgtcatatatttcatgatttttacacttaatctttcaactatgcttgttgtagtatattataattatctttcattctttatgtttacccaaaccggcagcaaaattaggtagatggcattttcagtgaataagaaatgtaatagagatggtgattccttataaagagaagacagactgtgagatacagtccctgatatgaaactgggatcagacaaacctctctgagaacatactctggttttcatctgtttggacattggcaaaaaccccaaacaagcaattacagggagaaggacttaaagtataggtctttggggataacgttttaagagcagagtaacctctgtgaaggaacaacattaataacagctctggttgtgtgcaaacaatacttttgtacagtggtcttatttgaccctacaattctgttttaaagatgagaaagtggaaagtcagtaagtaaactgttcgtgatcatataccagtcagtcaacggagcaaaaaggtgaagacaaatcatctcattccaaactttggactctttttaaaagcagtaaaaatgagatctgtctacaccagtgttatccaataaaattttctgaaggctgagttcagtggttcacacctgtaatcctagtgttttgggaggccaaggcaaaaagatcatttgagtccaggagtttgagcccaacctgggcaaaatagggaaacttcatctctataaaaaaaaatttttaattacccatttggggtggcatgcatttgtagtcccagctacctagggggctgagcaagaggatcacttgagcccagcaattcaaagttacagtaagctatgatcacaccactgcagtctgggcaacaaacagagcaagattctgtctcttgaaaacaaaaaacagaaaacaaaaaacaaaaaaactttctgcactcttcaatacaataaaattaactacctatgtctatttgaccaaaattattaatgaatttaaatttaaatagcagtggatagctagtggctaccatatcaggttgtgcaggctctatactgtatgcagatggataattgaaagttatttaaattattctcagtaatttgaatatatataagtatgggacaaaaataattaaaccaccacatattaaaag

SEQ ID NO: 184 - DNA, 110527 bp, Homo sapiens
gacaccactgtcatttctattaggcaatccatgtattacagagtatcatacattcagccactttcttcacacacttcagagtacagaagtagtagcatgagtacatgaaaggagaagtaggatgtctgggatctgttcccagtgctacaattgatgcactattcttactccctttgcattgaaatctcccatctgtagcacaaggataatgacatagtacctgtttgtttctaaggcactggaaaattctctggtagaagatactatgcaaatgcagagactattattacaccaggaagacttgaaaattgcaagttggtgtgctcatgactattaagcagttgacacagtgacaaaagagagagcatctttcttcaaggcatctaaaatcaagtattgctgaatatgcagctattctgaaaaacatatgtgcaaatatattcgttttaatgaccttccaactctaactcatcaataacccatttaaagcaatcctttccaagttatcctgactccaacaaaatgcatggaatccctaatcactgatattttttataatgcaaagctttctgaaagattattctttctccttgcaaaatatttgctttactccagaatttcagagagcattctggctcattccactaagattattccaaaatataaaaacatttatccttcaatctgctaatcttggaataatcaaacttacagtacagtggtggacaggcatccaagcaggggcttccactgaacaattctgggctgggcatctgccttggttttgctgcaaataagtaaaaattatattatattctatttattatgggccagtatgtatatatgctagctgacatgtttattatcaatatgtttattaccttatttataatcatagagagagaatgctttgttggtgcaatgctgcagaaaactaggtacataatttctactcttatcaaagcataagaaattatccttttccttttttgttactctaaggactaggtttctggcaccaggctgtctcagcatctggccttccaggcttcaataccaaccacctgagaactcttacaacccataggctgactgttctcttccaggctcctaatcaaccctgaaacatgctgtactcctgtaagatcacatgagtcaaggtatagaatggctgtttatttgtctctgtttccagactataagctagtgatggtgattctctctagagtgtttcatagaactccagaatgttgggttgaaagggatagatctcagaggccttcttatcacatgaaaaactgaagtgcagagaaataaaacaattttctcaaggagtcagaaatttgacattctaaaccattttccaggcacttctttatacaaaagaaatttatctctagttaacctatacttttgttgtaattcctgtaaatttacttctaattggcttttaaaaataatacagtgctttactttcaccaacaatactgctacacccctttgataatgaaaactgattagtccaaaagggggggaaagattttaataagccatactttatcttttatttttttcattgtattctcagtgataatataggcatacttataatattaataatcgccataaaaaccacagctgtgatttactgaacaactaaatatgcaaggcactattctggacacattatattattactagtccccacaataaacataagtaggagtattatgctcactttctagtggagaaaacagagacttagagaggttaagcaacttggctaaaactcaacctactagacagcagcatctctgagattgcagcaagactctggctgactctggtgcccatgtatgctctttcttttatgagaagttgcctctgttattttagactgtctctttaatgggaggtaagccatgtcatcatccaatctgattttatctaatgaatgatcctaacatttctgatttaactgaataaaatactgaattcagtactcctatcacactaaaatttttgcctgtgatttgtaagctttttagagcaactttatttggttgatctatttttaaggcatcactaagccctaaaatgctgtatgagtgactatggataaagtcatcataaaaataaacttatatcatcaatctccatgatcaatttctttaaagcaaaatatgatatgcagcagcagcagcagagtacagaaggtacactggtcagataaccacaattttaagctaattttggccatgtgcttgctgccatgaaatgctcttgacagtcacaactgtgaaacagtgttagtattttgcctaattcacagataatagatatagattctcctcagatcattatcacaatttgcaaggaagctactaatgagaacacacaacatattcacaaaatatgacgggtgcataaataaggtgtgtttcaacttctgcggtgctcagcatgggataaagaaagatggaaatgtgtgtttctgttttgccttctattattacctgatttctgacactaagatcttctcgtacgtgttttaactaagaaaattaacaatgattttacaaggccagacaaataaaaaagactagtgatgacacatgtcatgtgaacataaattattctttaatcctattgtatgataagcaaaaaacattgaaacagaagttagaaccttggattttagtttagtgttcccattgatctacctgtggaactttggaaaactcactttaacactttagaccacacttttctcatctgtaaaatgagaaagtttcttggatccatcattcaatgtggagagaggaagagccaaatctacccaaagatctttcccaaactttatagttctaccaagaatttaatatttggttttatctaccaaagtggtataccctgcagttgagatcatttatcattctgatatactgatgagacatcttttagggtcttgggaatatgaacaggaaatggttatttccctgtgagtttcagtgctagcaaagatccacaaccactagactagatggtctcaaaagagccttccacttaagtgtggttactgaaaatcctaacctcatgttttgtctaccacttcgctctacttctaaagaaggcaagatctaacatggatcagggaacctaccacagcaggtggagaaggaaagggatttaaaattctttttcctcgaagtcttcattctccttcttcagtatcttttgtttttaacatttaatgtgtacactgtggcataacagagtttgggcctacctcctactcaaaagagtaggaggtcagctccttagaagcccagctagaaccagaataaacactaggggaaaggacactatcatgtctaactcttagttaattcttaagccaaaaatcaagggagaacattagaattccctcaagggagaacctagctctctaagcaaagatttaagatagaagttggtgacaaaaggtaaagctttcccaccttccttctgtctcattcatctatccaggatgtttatacctgtagattagtgatatgtgactagaccaggattcggggatttgcaatgctgaccgttaaaaacatgtcctcttaagagacaaaactatcaatgggtcttagtcttttaaaaacagacaggttgatgtctccaaacctctcatcttccttggttatctgtttctcactttagaatcttgacatatttcattccagaatattctgagaacattagctaaatatgctgaccaattacacctgagattgattgtataaatatgtaactacaaagaactcgaaaagtgacctagagaaccctaaagatgttcttctcaaacaaccccatccctccaaaaacatgggaatatttttttttgtgtatcaggggcttatacacagttagagtgctttggagtttagaaatgcttatatatacattgagccctttcatccccagaaaaagttgtgtgtggcagagtgagagatgattcatacaaataaaattttgacctaaatgtttcattaaaatagcatgttcttttgaaagcagagtaagagctgaaaggttctgttgttctactgttcacagtaaaatgatcctcataaacaaaggagttttttttcggggtgggggtgcggtattgagaagtattgcatgatagaactgtacacatatttgctcattcatttacccatccctcagttaccaaaatacactccatgaatggtacgttaggtatacatatagattttaaatttagaactaaaaaatttaaataatccttattctcctaaagcccccaaccttttaggagatacaatacaatgtgctgagtttaaaacagggttaaataacaggaccattcatccattcatgtagttggtcaacaagcatttattgagcaattactaagtgccagctattgcattaggaataaggatatatcaagagtcagtatctgcctaaaaaagtacttattctaaggagaaagataaactaataaagctgcagttataaagcaatattactgatatgggataaataaaccatttcatgacagatcaaaaatattcactgcactcattcttggggcaggagtaagaaatgaacaagcgtaagggaaaattatacagaggaattgaggcaaaaggtggaagtatttaactctggctgggtaattcagaaatgtctttttgaagagacacttcaggtttccaacacagttttaaggaggcgaaggtgtaagaagagggcgttacaggctaaaggtaactcaaaagaccatctgatagtgcaaagtaaagacattattggccttgtcaagaaactcctcaattctggacctcagaatcccaggactgaggagaaagaatgattttatgctatacagagagctgagttcagcctttccctttatctcttcttcacaagactaaatggacagcagggtgtgggataaatgaatcctaccaggaagtggacatggaaggacccagatctgatcctgtaaaacacacaagaggccctcctgagtttaatctttgaacaagcatttcagctgtcttactcatccgtgagactctaaggtatttgacagatgaagaaaaagaggtcaaaacgtgatgcccaaggagcagaactaagtggctttttgcatgcagaactaaaatgacatgcaataatgtgtatgcaaatggactgtgagttgtaaagtactttagaaatgtaatggataattataaagcattaattatttgaaaattaattttatgagctaattcttgttattaaaattactagaacactttctgacttctagtccaatatactctctagcacatcaagagttaaaaattttttcaaaaagtttgaggaaaaacgactcagaaagtgcctccaaatcatcaatttcatatatttctaaatatagagatataatatatatctatatttgtatgtatgtatctacatacacatcatgtgttcattatgcatcatccacataatgtgtctatagatacatatatacttacaaatatgatttatgtgtgtgtatacaggtgtgtattaaaaaattattctggcaaaataaaggttttcattgaattagttttctaatttcccataaagacatgtaatttcagagtgagatgtttaaaaaaagagaagatcaaatcttgccatgtgctaatgtaaaatacattataggtggaaatatgtgcacaaaatgttacattggaagtcctaagacaccaagatataaaaatgagattccaaaggaggctagaccacgtgtgcaatattcaaataaattaccaagaaccaacttgaggatcctgaatcctatctataatgtaatataatgctggtatacaaaagttagatgactaaagatttagaaagggggagaatatctttgaagaggggttgagaagtcttacatatcacctacaattagcaaaagaaacttcaatgggactgcacctagagcttaacataacttccttgggtttaggaggtcagtatactgggatttgactctcacctaagaagcttaaccagtgagataacgtggcaaattggttcttaagtgagaagtggcttcatatgggttagcctgcactctcagagttcgtcaaggcaaaagattcattctggagccattgtaacacctgtcaagacaaccctccatatagggtgggctgctgtaaaatgtgacgctaaggaaatgcctcatccacatcataggagatttaggcccagaaggggaaacttccaaagactgaggaaagtgtccatgagggaaaaactcaagccagacattttctggctgcgttaaaatcccagatccactgtttgctagctatgtaaccctaggcaagttgctttacctctctttgcattagttatgaagattttaaaagttataagtaaagcacttaaaactatttctatacataatcagcactatttgtcagtaattttcttcctttttggttattcttactgttattatatgtcaggttcggaaggcaaaaaacacaattccagtttaataagaactttccttgtctccttttcttatttccctcttatgctccaaacttggaaggatcaataaccaactagtaaataggtaaatagaaaaaaaaaaaaaagtaatcgtaaataggaataaaaaaaaaaactagtaaaaaaaaaaatgaaaagagaagtctatgacatccccttcccccaaagcagatgtcctgtctgaagaccccacagtggaaaaaagagaatctttcatctggaatgtgttcagaattttgactaatatttgggactgagcaattttaattaatacattgggactgtatttgtgatattaagtgattgtaggacttttcatttcctgtaaatggaaagttatgagaatacccgttttcatttagagggcagggtaaggaccactgacattaagccattttaaacaaacaatggggaatccaaaataaaatgacttctattattacatcccatgagtattccttgttcaatgtgtcaattacagatgccaaacatactcatggttagtgttaacttttttcattcaactttgggcatattcctcaacatatgacttcatcccttcctgggcttatccttccatttgcttctttttattttctcaggcttcaaaagatgtttaaaataagttggcctaatttgtttctgaggaaatccttactaaaactgaagccatgctggggagtcatgaatttgcctcttttgtaaatgaagaaaatgctgctgacctattctccaaaggatgctgagaacaagcgtttttcagtgggcagtgatgatggtgctgagtcatcctcaacacttttcaaaatcctttgtgacttcaggcagacatttgcccaggttaacagaggtgcagtctgtggctaactagtgcataagaggattaaacactctacattaaaatattctaagcacctagctacccagattaacagtaatgagtggaataggctctgagttttcaagctggccacattaaaggattataaatggaaaccattgttgtgacttgatatttcagggtatcaatggggagaggacagcgggctttgacttaggaagcatttcctagatgtatgatgaaataatacattgagcaccattagatcccaggcacttgacatgcattgtcagctcattgtatcatcacattaaccctagatagtagaggagagagtttaataccatgaggaactgactggacccgggttacaatgccagagttttcactttttacatctgtggctttggataaatttcttaatctctgtgagtttcagttttctcatccataaagtggaaaaaataaaacctagcttaaggaattattgtaaggattataaaactatatacattataatatatataacatatatgtctaggggcctgatatatactctaatagtaataagataaatactatataatttacatgttaatatctatcttattaattggggatctttctcctgtttcacttagctcctctgagtctatattcttgtatctgagtataaaatagtaatatttatctcacaaggttactatgaaaattaaatgagaaaaagtacatgaaagcgcttagcaaatgtcaagaactttaaacttaagttttgtttgtaacttttttgtcagtatatagaagatggaaagaatgtctgaaatactgcagcaatttaagataactaaatttgggagccaaaaccgattctgcagtctgggattatttacttgaaatcattggttataaatatttctaaaaaatataatatggtattttagtattttatggaggcatgtcccaatattctctgaagctctgtcagtctccaaagtttgagttattactatgcatagttgaatgcaatagagtaatttaagctactaaatacaagatttaaaagcatagttttgtgaaatatttttaatgtaattaatatttgcattctgtcattgcatcctagtaatcagatgagaaaaacggaatgggctgtaattgtacttttctccttgcaaaaaggaaaatttggatattattactactatagaaaataaatattttttcattggcagatcttatctattataaactacaaagtctcatggaaacataaaagactgtaacttctaaaacaagctacttttttcttccaaacatatttataaattcacttagtaaaaatatatgaaatttcaggaccccaaaataaagtcaaacctttgaagaaagaaatgccattcagaaacaagatgaaagtaattcacttctattctctctgctaccatagagacaaagaaaaaacaaagtaaagagatttagcacacttaattcttcctgaaatttataattaactacatgggaaaggtaacaattaccatatttccaaagaataaagaattttaaaagttgagcttttgataagacataattacaacctattaaatatgcaattcatacaaatttgcttatgatcttcttgaatttcaaaaaatgcatatacattggatagtgttttctgaaaagtacacatggaatgccaccaagttaattgtacagagctttctcttatcggaggattttctcagttacctaaaatcttggcaaaacctaacacaaagaaaagggtcaatggatattacttgcatatatgccctgtcttcctgacacctatgaatatgtattttgggacaaatgttaatcaacaagaaaatgtgcaggcttttgtagatcaagtgccatggccaacatcaagcaatagccagaacggactagcaattagatatgttctcagtttaaacagaactttagatttctaagtaaattatgggtgtattaattcaggacagttttattttaagagacttgcaagaaaacaccatatctagaaatcctaagagattcaaaacaaagaaagggaggaagagtttattttgcttaaaatgtatactttcatttatggtttctttagcaaataaattttttaaatttttatcattaagaatatcaagaaattatccttgtaatgtcctatttagaactctatttaaaaacaaataatttattttattttagggtatcttaaagacagcatcaaaggttatatttctcattgtaaaagcatgaagtatgcgagaggtaagctaaaaaaattaatactttatgaaatgtgttttcatacaaaaatcaaaattcttgctggcatagataataaatggtatgatttatgtcttgaaatttgacttttggatattcttttttgaaacataattaaatggtcttcgaggagactctactgctaactacattgctgcttggtaaagtggtataatagattattctaagtcatttctgtctaggggtttcagaacaattttaagggaacatttgaaagtctgtaaagcttttaactcagatcttaaccacagaataacgtaacatccattcagctcctgtatgcatagtgctggtgtcatctgtggctagttggacaaattccaagtaataattactattatagttttttaagttccttttgtaggttacttgggataaagccatttaatgatactgatacactttgttctctgaaatgtaaaccagtataaaaaagtagccgaactgctgtgaacctcttcctagacaagtttgtatcctgaaagttgagtaaaacataatgtattccacttaaaaaaattatattatttctccaattattttataacctgataatttaggagaataacatcattttttaattttctattgcacacctttctaactcactttaatgttttcatagtaaaatatactacattaatattgttattcttttatagtatatttatgataaatatgttatatatatattataaagtcaaataattttccccaaaaaataccatgctatattaaatcactaagaaattaaatgaacatgagttggcattcttttatcaaactgaaaagcagatctgactgctttagtttttgtttaataaaaaggtgcaattgtcttctaagtattttgtacttaaattttagaaatttcaattatgatcatgataatttggtttatcatagatgtgattcaattgccattttccaggtgtatataaggaattttacctctattagtccatttcttttatacaaaaatgacacttccaagtatcatttcaggctcaccaaatattcacagataagtttaccaattggctgtctcttaactgaatagtttctccatcagagtacaaagatttctttcacaactatttattgtgaaatgcacattatatatacacatgtacatatgtgtgtacatgtatgtatatatgctaaaacatttgtgtatatgtgcacatgagtctatatatacacacacagaagtacatggatatctacataagagtgttgtgtgtgtgtgtagtatgtatgtatgtgtgtgtgtaaattagaggaaggaagaatttcacccactcattcacttattgaacagtgaaatagctatcaaatgtctgttaaatgaaagaatcaatcaacacttgtagtacatctgccagtaccatggtaagtgatcagctataaatacaactaagaacttcccctgtcctcaaggaattcacattctagcaagaaataggcacatggaaaagctaactacacaaccagataaagactataacaaagatgcagacaatgtgcggagaacatggaggctgatgggctcagtctagtaggacaataccaaggaaagtacttaaagagaaatccgcatttagctgaatcttaaaggttaagaaatgtattagggaagtatcaagctaggaagttgagaggtattccaggcataagaaaaaacaggcacaacgaagaaacaagaggatgaaattcaaattatttggggaaaccaaatgttattgattatagttgactaaggcatgaaaggtagtgggatctgagataggcagttaggcaagggatacaacatcgagggccatgtgctgcaggggaaacaatgcagactttatcttgaagggcagtgcttctcaaaccttaatgtgcaaaatcaactaaggatacaaatcaattatcgatcttatgaaaacgcagattctgattcagtagtttcacacggggactaagatcctgcatttccagcagttttctagcagatgatattgcatttggtgaacaaacaaaattttgaataagggagcagtaggggacagggaatccctgaaggattataacgagagttgcagagttgtgatatacatgcaaattatatatatatatacacacacacacataaatgcacacacatatacacacatatatatgtatatttatacacatatacacacacatatttatacacacacatgcatgtatgtgtgtctgtatatatattatatatatatatatatatattttttttttttttttttttttttttgagacagagtctcgctctgtcgcccaagctggagtgccatggtgcgatctcggctcactgcaagctccacctcccgggttcatgccattctcctgcctcagcctcccaagtagctggaactacaggcacctgccaccacactcggctaattttttgtatttttagtgaaaacggggtttcaccgtgttagcaaggatggtctcgatttcctgacctcgtgatccgcccgcctcggcctcccaaagtgctgggattacaggcgtgagccaccatgcccggcctgtatgtatattttttaagggaaggttcaagttaatggtgtggaaaatgtataggagtggaaagataggaaaggtaggaagacaaatagggattctattgtagaaatccaggtaagaattagtgagtctctgaaaaagaccactggtagtagaaattgtaaataaaggacagattataaggaatagaataaataaggattggggctgtgggagatttaggaataaataaaaatcaaggttaactcctacttttctaaccatgacaactgggatagtggcatacaaagaaattgagcacagagcagagtaggagaactgtttatgcttggaagactccagagagtaaacattttccgggaactttcggcttaaatttacttaataggtaaatagaattccaaattccaagaactcattcatttactctcaaacccgtttctcataaaacctgtcatctccaaaaggttagctcgagaactgaattacttagatacaaagaaagtgatatgtgtgggtaagcatattaaaacagagatatgaggggcaaaggttattttcataggcttttgaatctggtactatctttgaacgcacaaatggaagaagaagctaaaacatttggtatctttctctcaccagtaagaggctataaacctgcaaagtattattcactgaagccagaggaaatccccatcaccatgactacacaaatagaaatttgccaccagagtggtaactagctaattgaattagtgaaatttatccttcagtgtcagactcccagaaatgaggaaatgagagagaaagaggagagggaacagaaacaccatcagctgctatttattggctatgtgtatacatagttgctacactaaaccttatgtgtatgttggcactagctactccccttgtctgggatgttctttgccaagaccttcacaaaggtgatcctcttagatcttcttttaacttaagtttgcttaagtatttatgtgacctgtgtcacttaagattacttctaacacatatacagacacagctctcatttttctctaccatacggtgatgctaatggtaatgaaagatgccaatttatgctaggatatcttattttcaataatttctctcatcctttccatgtatagagtacttcgtacttttcaaatatataaactaatttgattctgtacaataatcctgttcaggaactactgataagccagtattattaccccatttcagacttgagaaaaataagggtcagagaggataaagtgagtttactaagattactagtataataaatggaaacctcaagtctatattttctgaatcttgatccaacacatattctcagattgcctttggtgaaacatacatacatgcaacaagacaggtccctcaggtagctataatcatgggtaatctgctttaagaaaatcttatattccaaacattcaaattaaataatggataaatactaaagggcagtgatgaattcttttttgtacatcatgaaagatttataatattttttaaagttttgagcacagtaaaattttttttttttttgagacggagtctcgctgtgtcgcccaggctggagtgcagtggcgcaatcttggctcactgcaagctccgcctcccaggttcacgccattctcctgcctcagcctcccaagtagctgggactacaggcatccgccaccatgccaggctaattttttgtatttttagtagatacggggtttcaccgtgttagccaggatggtctcgatctcctgacctcatgatctgcccgtctcggcctcccaaagtgctgggattacaggcgtgagccaccgtgcccagcctgagcgcagtaaatgtgtaaatgttatctaagttgtaaaatttcatttgcagttgtttcctctgcagacccacatttgtctgagaatataagatttatgtaaaggtcttataaaggacaatactctcagtctcatagctcttcatagcattgtgttgtttttactcacagaatcaaaaagggctaatgttatgaagtaacatcctgtaatcatgtttggagggaaaaccatttactacagatgtgttaacagatgattggtatgattcatataataaagttttattttatttctaaaagtttagttttacagactatggatatatgtctgaaaaactacaaatctacaactaattgtaattttaaattaagccctatataagtgcattgcttttatttaattagatatttaggttgagaaggaatgaaatgcaaagtatattatcaagagtatattttaactaaataataactttgttgtgattcaatcaggagagaataatagtgaatgggaacatggatattagagtcataaagacttgagttggaatccccactataaaacttattatttctgtgaatgcacctcatctttaagatatgaaggatcaccaggttggtctaaagactaaacgtgtttttattaaattcaagtaccttcaatgtcccagacattatacacacacacacacacacacacacacacacacacacacaagaaaaaggaacacagttcctttccttatggagtttctgtctagtcaaaagaaagacaaaataatcacacaaatcagtatgcactatgagttgctatgtgtggaaatgtggcataaaaatcagagtgtactccaagaatacataaaattttaggaaaggtagtgacatgtaaggtgacatctggaatataagtagaatttagatgggtggatggtcatctagaaaaaaaaataacaaatggaagtcgccgaaaccaaaacatggttgacaccttcaaagaacggcgggaagccagcaaggccaatgtgtcctttagtttaatgaaagatagggaaggtaacacagatttaaaagatggtctcgtccatgtattttcaacattcttggagtgtaaaatacaaggtataatgaaagaagataagacatgagagaaatttaggttctaagtcaaaagagaatcgtatactttggtaagaatttgtgtaactactcatctttcaataggttgctgagagtgatgttgttgggtttgtgtattagaatgatcctcttgcagctggatggaatacttaataaaagaaagttaagctattatattaatggcattagtatttcatatgtctgacactattaaatggttaatcccaggttattaagacagtcatagaatctcttctctttctacacaaaaaggtcaggttatgttaaattttccctactattagctgtatttatgctcctctttgccactcaatacattttttttctgatacatcaagccccctgttccaatctcccccacgtagacatgccaccttgcagacatttggttggaatgacaagaattagaaccagtgtcattggcaggataaatacaagaagtgcaccacaaaaaaagatacaaagataaagaagctatagaccctaacaaagaacagagtgcctactccctacaaggtaatatcctaagcattttatagttcttatctcaccgaattcttaaaacaacgctgtgagataggtaccctttcatggatgagaaaactgcagtgctgagaaggtcatccagctagtaaaaggggaaaccattattttactgaacaggtataagaatgggcaacacaggttgtggcagaaaataggagagagctcaaatcagggggatgaaatgggaaagaagtctgggcaagctgggatttggaaccagttttaatgatggatggaatatcctatttcctttaagataacaaatatctcaacttcatgatatttgtgacagggtgctgatctatctctgcatcctctatatcttgttactcatattggacaccttacatcccagccatattgtccttccattcttgaaatgtgcaattcattctctctctctccccccgccccccacccactctctctttctatctctctctctctccccacacacctgccagagctttgcctaaaacattctcccaaccccattgtggctttcattctgcaaatcagcttaattttcacttcctcaggaaagcctcccgatatttatccctgcctaccctgcaacaaagctaatcaggttctttaggtatccctgtatccctatcctcatttccatagcactctatattcattttcttatcagacatcactgctatttctgtaattggttgttttccccattagacgaaaggttccatgagaacagattgcctgttgtatccccacacctttcaacatgtcaagtgcatagtaagcattcaatatatacttgttagattaataaaatgaatgaataaatgtgatgcttctaccatgggagcaactgtacaccagcatgaataaatagctttgtctatgaacacaagaccactcaggaaaccatttgttgccttggtgatttgtttcattttctctacatgaagctctggtggaaaataaaaatcattttagcttttccaaataccttatttgcaaatatttctgttaagaatccacttacaaaaggacaagatgccaccttttaaaaattaaagtcataataaaaaatattatattcaccagctgtgataaaaatatttttaatgcctggcaataacttttatttcctttcagtaattctgagtgatttttaattcttattaaagatagtgggttgacagaggcaaagagtgaaatcatatttacaaaacagatgtagtattaactacatcaagaaaagcttcttttgtgctgcctggtccacttttcactctgctatgtgaattttattatgtacattaacctgttatacataataaaaatgaatagtaccatcatgcctttattaacaaattatagcagtaacttaacatattgcagttttatttgtagattttttttaaactttttcaaatgtataagtatggttaatggatatctgaaattatgccaatgtgtgattcacccactactactatttaagatacttaacctaaacaattttatcttcagagaaaatatagaataatgttagattcaaaatagaaaaggaaatacctcagagatgcaataaaatatactcattttaaagaaaaagacaatggtggccaaatgcctttgggtgcccatggtcagaaagtagagatttacttttcgcagttccacacttttttctgttcttatatcaaatcctttatgttattacatatgatacttgagaattcctaagcagtaaaagaaaaattctattgactccttgcatttcattaaattaggcagaatattctgcctgcgatccagaactattgtcctattgcccaatcatgtaaactcatggctctgcctaacattattttccttatattttagttgtgaaacttattgggattatttatctttcaactactcaaaacatacgtagggaattccattatataaaatgtgttgcattagttattggattgtgtttagccagtgttattgagatgacttcatttacctcaatgatcatactgaggggtattcattaaagttataaattgtgagttgctgaataaattatactatatacacatttttccatataccaggaattgtgctaagtactttacatactccaccacaacatcacttagacataggtaatatatccttttcgaagatgaagaaatcagtgtttgaggaagttaaacaacttatccacatcttaaaactaatacatgtcagaacaacaatttaaatccaagtctcgctccagtatcctgctattcacactaaaacatgttctttctctttctcagaagtgatatctgtgacaaaagagttaaacttgaaactggacagaaacatttgagaaaaagagatgactcaatcttctgaaagtgggttgcctgagcatttgacaagacttgggatccatgtgacagaaactctgtatttatgaatactctgatgatttcctagtctacaagatcttactccaaatctgatacattctgcaaatcaatctaactagactggagctcttaagactttaaacaatctgagttaaatggggtaagatctaaggtgggattattttatcagagcatttacacaaaatccacaatcatttccttccctttatatgtagaaacaaaataaaaatgattctccatcaccattctaactggcatgagatggtatctcattgtggttttgatttgcatttctctaatgaaaagcaatcattgaaaagtcaggaaacaacagaatgtggagaaataggaacgcttttacactgttggtggaagtgtaaattcaaccattgtggaagacagtgtggcaattgttcaaggatctaaaactagaaataccatttgacccagcaatcccattactgtgtatatacccaaaagattataaatcattctactataaagacacatgcacacgtatgtttattgcagcactattcacaatcgcaaagacttggaaccaacccaaatgaccatcaatgatcaaatggataaagaaaatgtggcatatatgcaccatagaatactatgcagccataaaaaagaatgaattaatgtcctttgcagggacatggatgaagctgaaaatcatcattctcagcaaactaacacaggaatagaaaaccaaacaccacatgttatcattcgtaagtgggagttgaacaatgagaacatatgggcacagggaggggagcatcacacaccggggccttttgaggggtggggggcaagaggagaaatagcattaagagaaataccttatgtagatgatgggttgatgggtgtagcaaaccaccatggcacatgtatacctgtgtaacaaacctacacattctgcacatgtatcccagaacttaaagtacaattctaaaaaattattctccagtatgtctaatagatccttttatattaccattatacaattatattttctagatttatcagcatccctctgctcattaatcttcttacaatctttaggaatgtggaacaaagacaaaaggaggaatttatctctatagtatgtccagtaggggaaaatggcagaactcagagctcacagaggtctaggaggagccaaggggacagtgagggactttcatgccaaggaaagggaaggaggaacaaaaatgctattaccaatggaaatatttctgttttcctgccactaaaaacttgacaaaggtagcggtcagctgtggtatcgaaatgtgctgtgaatgaaatggagcttaggacgtatcataattaacagttccagtctcacataaagcttctgtaaagcaataattgaagacagcaccttagccagagctattggaaagtgaacttattgctgggggataaggagatgagtattaaactaagatataattaaaatttccaaattgtgggcaagtttcttgtcaaacagtcccaagaaagtagagcaagggcatcccaagtgcatggccacttggggaaaaacagtaaagtatcaacagtggtagactaaatagataagatttgcagtctaaagtcctctaagaggtctcttcacctatgtccagcttttgaagcaatcatgcattatttaccatttaaatattacaatgtaactttgctgtatgtttgttctttaaagatgttatatacatcactctagaaatgttcgtggatataactaagaaaatgaaatttcatgtgggtctgtgttttgttgattcgtataatttatatgataaatcacaatactggagtaatgacatttatctcttattaagaatttaaagcaaaataataatatgtatcacctatgtacctgtagtcaataatatttttataagtaaatataaggcatatgacattttttattagataatgttttccaaattgaaggcacttggatttcggtattgatttaatttgtataatatagtagacttctagtttgggttctcattaataacttttgataacttatttttacaatattaattatgtttcacagtatctaaaattattataatttgggaataaataatcataaaacacaagtagatcagatttggtagtattgtctcaagaaaagtaacacaagggtaacacctcaggaagagtaacatatttaagaggatatttcctttagtagattacataaggacatacaatttcctacttaagattttttaaaatttattttagttgatttactgatttaactggaatactgcatgagatgtttggcaatttttaaaagtaaaataaggtattcatctaatttagaggcctagtcaactaactcaactagaagttttaggctttaaatccactaacatcaactgaagctgccatgtgatattaggccatatgggaagatatccattatgattttctggggcttcatttgtaaaagtaatatatttaaggtcatactatggggaacttggtttgtggctttgaaattaaataatcttttcttcagtggtaaaaggagatcacaatgggacatctacacttagttaactctcatgtactaagctattaattttgttatgtttaatagtcatctaatcaacgtgagatacaaaaagatatggttcaaattaactcatggtatgcttacatgcaaaatgaaaagggaactaatgaataaatgtctataattagtttttcccaaaaatattaggaatatctattcaaataatcagtgattataaaatttaaatacattatttagaactgatgacagaataaaataaaatgcttttgaaatgttttgctattttctgtaaaacaaatccataaaacgattgcctattgattttatttcattcccacttttatttatacttccaataatgcaaatatttgtgtataattaaaatagaattagctaaatattaaatattgtgtttgttttaactcagggccttgagatttttttcctttaaaataaatcactaaaatgcagaatatcagaattctccaatcagaagcaatatgtcaagtcacagtaaagctgattggcttcttcaaacacagaagacatggtttttaaatgaaaagctaattatcacactcagaaagactgccctgatatgttaagttaaactgatgtgtatgtgctacactactactatagatatttctattatgagctataaatagatgcaaaagcaaatcctgccataaaaaaaaaacaaaaaacaaaaaaacaggcaaattctccttccatttgcacaaacatgcaatatcactttaagaagttaaaatcacataaagacaggaccccccagaccctcagggaacaaaatgcccagcaaagtaaattatactaatcattttctctcatgaactggcagcacctactagaactgtttaattacgggaccagaataataatagaaaaatgctgcacacaataacagccctgtttcctatcctacctttgtggtgacaatgcacaggcaatccatcctggatccctacacaggactcagtacatggaaatcacaccagcaaatcagcaaaggtgagaaaagccttttggaaattgcacacagaaagaagcagagcttggattctgtacagacggcttttccaagggggcccctcatgggaaactcgagccctcctccatacagctcaaggcaagcaggattctgctaggcaccagaaaatcccctagaaatcagctccggcaaaacttcccggtggcttcctgggctccgtggctgcatggtcttttagcggattccttgattggaacaaggctcctgtgagtgccccgcacagttctatcgttgcgatgagtgtaacaccaagcaccagggaatcacatttcagctcttgctcttgtttctgaattctgatgtgctgcttcagtatactcataatattttctttgccaaagtcccccctttgttgccttcctttcttactaacactgagtaacacaaaaaactacccgtcccatctaccaaatggctgtcgttccagtgccagaatagcggctttggataataaaatgctatttattatgagcatgattgccgggagtctaaatgactcgaaagatatgactgaaaagctaaggtgcatgtggtactgcatacatcacatctcaactcacttgcaattacaagggcagcttcttacaaatgactaacagctggataaggaaaatcaagccagtgacataaggaaactgcggatttggaggtttaacttatagaaaagggttacatttctccttttttgtgtttacctatgtgtgtggtccatgacatatgcaaatacacaaacaacctgaacatataaatgaatattatgaaattggggtgggaggaggttctaaagtgtttacaaaacttccacattctgagtgaaaaaatgagttctttcccaaacttttccctcctcacttgctgtctgcaggcacttattaagtgggcagagctttgtgttgccttctgcagcattttaacagccaaatgattagcactctcccctcccccaaatccctccctttcttctagtaaagctgctactacatagacggcctttgaggtgcttgacaagcatcactctggataataatatacttttttttcccatcatcttagacacacaggcagtcacagactgaaacagaaaaacagacacaggagctcagaaaggagagagggggtgggaagggagaatgagggagagtgagggagagtgagggagagtgagagagagtgaatgacagaatggaaagcactgcctgaccaataaaaatcgaaaatcaatgattcgctttcactaggaagaaaatacatagtcaactggaccattgaaatatcaaaaataaatgtctagggacccatacactttatctcctcaggatactggcaggaccatttcccaccccactactaaccaccaccctcttttttttttttcataaaaagtatactttcttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaaaaaaaaaaagtatactttctatgataaacaatttggaaaaaaataatataaataatatgtaagacttctacttttcatgaattattgaggttctaacctcaatatcccaataacctcctgattgctaaataaatgaatgtctcagaaactgacatgtcattattttacccaaatgagagcactgttcataaagattttaagttcatagcaaatcaaatacgtgttctgaggaaaaaaagaagaaaagacaagctcctaaagttcaatttgatataaaaaccttcaaaagtggctcaaaaaatatttatagttaaaaaatataatttcttctgaactgctatcctactgatgtaagaaatttcaagtaagtttcaagttaaacaccaccaataaaatccatgctctggtccattccattaggtaactctgtcttatggttcagtaatttgaaaaggtcaaagaaacaccagtttgtctattcaccctcatttgttacatcatcacaataattattttaactcaatacttcctaagcttatctaagggtgcgtaaaaccttatatctttatgtaccagcgtgtttccctggcacaactaacatctaataggtaattgagacttactgccatattcatgttcaaaataattagtctttgtgtccctatagcaccttaaagttgacaaagaacttgtaacagtctcacaggcttgggaagtttaaatgacttcctaaaagcctagtaactttcaatagcaacattaaagaccacgtcccttaattccaagtccaggtctttgttagtcatagagacagtcagaatggagacaatcaggggttagacagaggaagtaaataaattggatagcagagtaagatgagtattttcacaaggtatcctggaagatgataccttcggaacttcattccatctttgcagagaggcagacacttagagaaaaattagcaaagggagcctgattagtcttctaacgttggtggatcacagaggaaagcactttgtaaactatagagacttgcagaaataaaacacagcttgtctagcataggttctagaataccttaggcagtccctaagtcattcacctgacacatgtttgttgagcactcattatgtgattatttgattaatgtctatatcaccctctaaaatgcactccttaaagatagttttaactctttatttccattgcctagactagtgtctcattcattcaacaaatatacttgagaatctacttatgtggaaacacaaagtgaggaaaagctagcaaaatccctgcccacaagagaataaaaaactataataccgtacagaaagcatttgggagtgttttacgtctacaaaatagaggcatttaacccagaatggagcagtgagggaaagctttctggagaggggccttgagctaagatgaggaagaaccataggagttaactagaagttaggagaaaagagaattgcgtgcactctattgtatttgaaaaaggaatgaatcagcaatatgttatacctttatacaatcagtttaataaatacatccaataaaagtgcttcagagcaagcattttacagcaagcattttacaaactgaatatgcaatctttatttgagaaagaagagcattgctcatataactttgagtacaagtatactgtaaatgcatgtacaatatgtatgttatatattcatttgtttgtattcgcctcaagtgattaactggataatgtatgtaggtttagatataagtacataacattttgaagtgtagacccatttgggttttccactttgtgtataccttatctttgattgattttcctcagatataaagatgatagaggataattcactcctttgcctcaagggaaacattatgttgtttttataattaacaaggtattgacatgaagcatttttttttttaacagacacagtgctcagttgggcctgtgattttcacaagaagtctttggcaagataaaaagcctcagcctgcaagctgctttacttgatattccttgaggttaatgatctaaaactagaaatatattgattcttagtaaaacctatcattgaaagtttgatatcataaaattactcttgtaaattacttgcactaaacctgtaccttaaccacttaaatccattattacttttattttgtttgtttccaacagggaaaaatatgtttagaagtgaagtccagtcagtgtctattctagaatctaagccccttgagggcagatttaatgtatatatctggcacctaatatggtactggcacttaagaggcacaaaatcaatattagtggaatgaaagaataatcacagctctagttatgctattttttgatagtttttaaaaaatctatttaaacttatgatcccttattcatatgagaaccatatatttatattaattatatacatatatacatatgtgcatacataaaaatttaaaaataaatatattggtgcatgtagctgaaggtatttgcaaataaaaatattttcattggaaaatccagtctgatgtaagaaggtatggtttagaacagtcttatctataatggagaagggcaatttctagctgaagtgttacaagtacaggatgctactgaaactaggtgcttgctattgtgttagaaaaacagtaataaatataagcatgttaataataatagtaatttatcaagtggctattatctgaagtactggggtaaatactttgtaactattatctcatggtcataataccctttaggaaataattataatccctattttatagttaaggaaactgaagttgcttgaggttctatgacctgccgtgacacaaaacctaggtgaccccaacacagagagtggtctatgttatttccgtctcatcacactgcaaatcctgaaatcgtttctgtccctctgggtccaaactgagagtatggcacaaacagatacaaaaggccttctccttagccaaaggtagcctggactccatgcagatgaactataaacaacctgtgatcctcctaaaaagataggttcatctctgggttcctatctgacaccttccatagcttataagggccttgggaataaccccagaaggaatggactccacattagaaagattaggtccaaaggaaataacaagaaatccacccacctggcctcctatccctgtctatctgttccccatatacccagaacagcaggcacacaaatgacatctgcaaagcttgttagcttagtaaaataaatagactgcaggcaggtcatggcaaaatgcctgccctcatttccaaactctccagaggtaagtaagaaattaggatcaactgaaaaaagactgaatttttcagagtttctatcattaaaaaaatcaggacagtaatggatcccgaaaataattcatgaaaagcaggagtctatgtattctgttcaagttaaatgtgtatccttacaaaaaaatataaaaactaaacaagcaaaattttgagtgaaccaataattgctaatgaaatgaattaatttttagttttaacccatcttttaatcatgatattcaattgtatggacctaaattttatgtcagtttttctcatgtgagttggaacatagttaaatgatagccatgtagctctcccagttattatcatcatcaaaatctaaacaacctttgaaattttatataaatggtaggttataatgtaaacattcaataaaaattgtgtccctaacaaatcaaagtttacataaactttgttgaacattaactacatttcttatgaggctcaatttttcctattatacaatgctgtgggttgagtggattccagaaatccaaatagttgtgtgcaagccacaaatctaaaaagctataatggtcaaaaataaaattttgctttcaagtcaatataaataacctcagcagtattgctaaatgccattcccatactccaccttcttataccctgatatggtttggttgtgtccccacccaaatctcaacttgaattctatctcccagaattcccacgtcgtgggagggacccacgggaagtaattgaatcatggatgccggtctttcccatgctatacttgtgttatggaatcagtctcacaagatctgatgggtttatcagggatttatgcttttgcttcttcctcattttctcatactgtcaccatgtaagatgtgtctttcacctcctgccatgattctaaggcctcctcagccaagtggaactataagtccaattaaacctcttgttctttccagtctcgggtatgtctttataagcagcctgaaaacgaactaatacatacccaaagcacactggcctgttacctgttcctcaatatagtgtttcactctaattcttcctccgggccttgaatttgttgtttcttctgccagaaactgtttttccctggatttgcacatggctggctccttctcatcattcaaggctctgctcagatgttaccacctcagcaagaccttcccaaactgatttcccctaattagaatctcttccatcccttctccattacatcatcccagtttatttcctccatatgattatcacaatccaaaattatcttctctattcatctcttactatctcccctatctgaagtttaccagtgagagcaggaaccttatgttttgtccatggcaatctcaccagtgtttagaacataacagatgctaaacagagatttttgaatgagtgaatgaatgaatgagatgcatcacatggaaactctttaaaaagtatatggctagaatcagcagtccaacatgaaatttgcaatgcaagatctttaacatagtttggtttctaaggatctgatttacactaacaatagtatttacaaacatacacataaacaatagttttttggattcaaaattaatttattttgaaataaattgtattgggaataattaaggtatacaacatcatgtaagatatatatacatagtaaaaaggttattatagtgaagcaaattaacatatttatcacttctcatatagttacccattttttgtttttgtgtcaagaacagctaaaatctactcatttagcatgaatcccatatataatacaatgttattacctacagtcctcatggtgtacattagctctttaggcttcttcatagtacatatctgctagtttgtatcctccagcctacatctcttcattcctcccaactcagtaaccactgttttattctgtgtgtgtattttttaaattttattttgtatatggtaagtatgtgtatatgtatacacacacagatagatagattccacatatatgtgagattatgcaatattttcctttctgtgtctggcttatttcacttagcataatgtcctcccaggctcctccatgtcatggcaagtggaaagatctcattcttttttaaagctgaatattattccatattatgtgtgtaccacagtttctttatccattcacccactgacaaacacttatttccccatcttggctattgtgaataataccgcaaaggtcatacgagtgcaaatatttttacaagattgtgctttcatttcctttgtgtatatgcccagaagaggaattgctgggtcatacagtgttgtatcttcagtttctttagggacctccatactgttttccataatggctgtaccaatctccattcccaccaacagtgtacagagttcccatttctccacatcatcaccaacatttgtcatcttttgacttttatttagaaatagtaaacaatttatatgacactcccaaaacaaagaaaggtatgcacagaataatttttgtagaaaatatgcatttgtaacctatctttttaaaaaattatgagtacatgatagttatatatatttatagggtacatgtgatgttctggtacaagcataaaatgtttaatgatcacatcagggtaactgggatatccatcacctcaggaacttatttttttttttgtattagacacattccaattccagtcttagttttttgatatatacaataattattgttgactatagtcaccctgttgtgttatcaaatactagatcttattcattccatctaactatacttttatataaattaaccatccccacttttcccctccatcaccactactcttcccagccttaggtagccatcattatactcttttctctccatgagttcaactgttttaatgtttagccacatatgacacagaacatgtgaaatttgtctttctgtgccaggtttctttcacttaacataatgacctcaagttccatccatgttgttgcaaatgataggagttcattcttttttgtggctaaataatattccaatgtgtaccacattttctttacccattcatcagttgatggacactttgattccaaatcttggctaagtgaataaataataaatacaggagtgtaggtatctcttcaatatgctgatttcttttcttctggataaatacctagcaatgggattgctcaatcatatggtaatttctatttttaatttttgaggaatctccatactcctctccatagtggatgtactaatttatactcccataaacagtgtatgagggttaccctttctccacatcctcaccagaactcattatttcctgccttttggataaaagccattttaactggggtgagatgataccccactgttgttttgatttgcatttcttgatgattaataatgttgagtatttttcatatatctattggctatttacacatcttcttttgagaaatctctgttcagatcttttgtccattttaaaatcagattatttgttttttttcccattgagttgtttgagctccctatatattagggttattaatctattatcacatgaaaatatttcctcccattgtataatttgtctcatttgttgattatttcctttgctatggagaactttttagcttgatgtaatgtcatttttctatttatgctttggttgcctgcacttctgaggtattactcaagaaatttttgcccagaccaatgtcctagagagtttcttcagagttttctttcagtagtttcatagtttcaggtcttatatttaaatctttaatccatttttattttatttttgtatatggtgagatatagggttgtagtttcatttttctgcacatggatatccagttttcctggcacaatttattaaagagactgtccttttcccaaaatatgttcttcacacctttgtcaaaattgagttcatggtagatgtatggatttatttttgcattctctattctgttccattgatctatgtgtctgtttttattccaataccatactggtttggatactatagctctgtagtataatttaaagtcaggtaatgcaattcctccagctttgttctttttgttgcccatgatggctttggctatcctgggtctatactggttccatacaaattttaggattactttgttatttctgtgaagaatgtcattggtattttgatagggatttcactgaacgtgtagattgctttcagcagtatgaacactttaacaatattgatttctccaatctattaacacaaaatatctttccattttttgtgccctcttcaatttcttttactaatgttttatcgttttcattgaagagatcatttacttctgtgattaaaatttattcctaggcatattattttatttgtagttattgtaaatgggagtttttttcttggtttctttttcaggttgttcattgttgacatttagaaatgctaatactttttgtatgttgattttgtatcctgcaattgtattgaatttattcttcagttctattagtatagttttttggtggaatttttaggtttttctaaatagaagatcatatcagctatgaacaagaataatttgacttctttcattccaatttggatgccctttattatttctctcatttaattactctagctaggacttccagtgctatattgaatagcagtggtaaaaatgggcatccttgtcttgttatatatcttagagaaaaggcttttaatttttccccttcagtctggtactgtgtaggagtctagcatacatagcttttaattgtgttgaggtatgttccctctatgccacattttttagcatttttgtcacgaagagatgttgaattttattgaatgcttttcagcatcaaatgaaatatggttttatccttcattcggtcaatatgatatattacattgattgatttctgtatgttgagacatctgtgcatccctggacgaatctcacttggtcttgatgaataatccttttaatttgttattgaatttggtttgtgagtattttgttgaggatttttgcatctatgttcatcagagatatttgcctatagttttcttttttgatgtgtctttctccggttttggcatcgtggtaatactagcctcatgaaatgagtttggaagtgctccttcctcctagattttttcaagtagtttgagtaggattggtattagttctttaaatatttggtagaattcatcagtaaagtcattaggtcttgaatttttctgtgatgggagacttaattatgacttctgtctcattacttgttattggtctattttggtttcagatttttttcatggttgaatcttggtaggttgtatgtgtctagaaatttatttattctagattttccaattctttggcatatagttgttgatagtatctctaatgatcctttgaatttctgtgatatcagttgtaatgtcacgtttttcatctgattttatattgcggtgtcttctctcttttgttctcagtctggctaaaagtttgttgatttactaatttttgcttgttttgcttttgcttttctagttccttacaatgtatcattaggttatttatttgaaatttctctactttttaatgcaggtgcttattggtatacttccatcttacaattgcttttgctatatcccataagtttatgtatgttgtgtttccattttcatttgtttcataaaatcttaaaatttccttcctgatttcttcattgacctgcttgtcactcaggagcatattgtttaatttccatgtgtttgtatagtttccaaagttcctcttcttattgatttttagttctattccatagtggtcagaaaagatatttaatataatttcaatgttttgaatgttttaagactcattttgtactttaacatatggtctatcattgagaatgacccatgtgctgaaagaaagaatgtgcattctgcagcttttggataaaatgttctataatatctattaggcccatttggttgacagtgtagattaagtctgatgtttctttgttgattttctgtctggatgatctgttcaatgctaaaaatgggttgttgagctctccagctagtattgtattgtggtctttctttctctttagccttaataatatttgttttatatatatgggtgctctagtgttgggtgcatatacatttataattgttatatcctcttgccaaatggactcctttatcattatataatgtccttctttgtctcttcctttagttcctatcttagaatttattctatctgatataggtatagctaattcctgctctttcttagtttacatttgtacagaatatctttttccatccctttaatttcactctataggtgaagtgagttttgtaggcagcatataattgggtcttttttttttttttttatcagtttagccactttatgtttttcattggaaagtttagtccatttatagtaaacgttattattgataggtaagaacttactcctcccattttgttatttgttttctggttactttgtggtcttctcttccctccttccttcctgtcttcctttgtgtaaaagtgattttctctggtagtatgttctaatttcttgcttttacttttctgtgtatctgttgtgggttttttgatccgaggttaccatgaagcttgcaaataatatcttgtaaaaaataattttaaactaatgacaacctaactgatttcagaaacaatgcacaagcaaagagaaaacttaaaaaaaaactctacactttatcctccatgttctttgacttttagttgtttctatatatttttatactatctatttcttagaaatatgttgtagttattatttttgattagttcttttactattcctattcaagatatgagtggtttacacaccacaattacagtgttgcagtattctgtatttggctgtgtatttgctgttaccagtgagttttgtaccttcagatttcttattgtttgttaatgtccttttcttttagattaaagaactctctttagcattgctcttaggacaagtccactgttgatgaaatccctcagctgttatttgacttgtaaagttttatttttccttcatgtttgaaggctattttccctggatatgctattctaggataaaagttgtttcattttttttttccttcagcactttaaatatgtcatgcacctctatcttggactgtcagatttccactgaaaaggttgttgccagatgtatgctcccttgcaatgttgcttgtttcttttctcttgcttcatttaggatcctttctttatccttagcctttgggaatttgattattaaatgtgttgaagtagtcttatgtggattaaatctgcttaattttctatgaccttcgtctacccgataatattttttctaggtttggaaatgtctctgttattatttctttaaataaactttcttacctgatctctttctttatttcctccttaaggtcaatacattttacattttcccttttgagactgttttctagatctcataggtttgcttcattctctttattatttttttcttctttcccccatggctgttttttatacagcctgtcttcaatctcaccaacttttccttctgcttgatcaattctactcttcagagattcgaaagcatttttcattttgacaatagaaatttttcagctgcagaacttctgcttgattatttaaaaaattatttcaatctgcttgttaaatttctgggataagattttgaatcccttctctgtgttatcttgatgctcactgaactttctcaaacaactatttttaattctgtttctgaaagttcatctatttccaccactctagaatttgtcactggtgacttatttagtttgtttagtagatcatgttttcctggatgttcttgatgcttgtggatgtttgttaatatctgggtatttagaagttaggtatttattttaagcttgcagtctcagcttgtttgtacctatccttcttgagaagggtttccaggtattcaaatggaattgggtgtggtgatcgaagtctctggtcactgaagccatatcaacactgggagataccgcagaactagtaatgctgtaattcttgcagactcctagaggtaccaccttggtaggcttgggtaagatctggggaattccctggattactgggcagcagtctctgattctcttccctcacttctcactttccccaaacagaagtctgtctgtatgtctgtttctccctctctctctctctctctctctctctctctctctctcctgagcttcctggagttgggggagggatggcacaagcactcccaaagctatcacagccaggactgtgctggataatacctgaaggcatcacagtatttgggtcttatccaaggtccatggctactctttcctggctgctagtgatgtttcttcaatgcccaagggctctttagtcatcaggtggcatatttagccatgaaggggtccctcctgtcaggggagcaggttcccttctagccaagggtaggtctagagatgccatccaggagctaggacctggaattaagggtttcaggatccagcgtggtgctttattttaccgtggctgagctggtacccaggttgcaagatgaagtcctttgtactttttcttctgctttcccaaagtctaaggagtctttcccaagctgaatgcctggaattagggaggggtaacacaaacacttccttgggtgtgacaactagtgtctcactgggtttcatgtaccccaagtccactggccccaagcccagagcagtgccaggacttatccaaggactgcaaaccttgttacctgactgacattcaaatttatctaggacattaggctactttagtcagccaatggtggagctaccccaaactcaggttcctaccactggggtggagaattcccctttgaatggagctagtctaaatgcttcatctgtggacaccggtggaattttgccctatgttgtattctgctgtgagagggcagaattgagttccaatgcaatgtctcacaatcacttcactctctctcctgcgaacacacagattttctgaatacatgccatcggttggggaagggtggtataggcaatgcgaaactgtctttcctaccttctttagtgtctctttccttgatatagtatttaagccagctactgtgatcactcacctaacctttggttcttatgaaggtgctttcttgcacagatagttattcaatttggtgttcctgcaggggggataatcactggaacgttctattcagccatcttcctctgcctccctcctatctattgactttttgataaagccatcctaatgagcgtgaagtggtttctcattgtagttttgatttgcatttccctgatgattgataatgtttagcctctttttatatacctgttggacatttctgtcttctttgaagaaatatccacccaagtcttttgcccatgttttaattagttatttgttccactactgagttgtataagttctttataaattttggatattaaccccttatctaatatatgacttgcaaataaccattaacttttcatttaccaagtataaattttcatatgcataatatcattaagtattcataaccaatgaattaagtataattttacaggtaaagaaactcagactaagaaaaactgacttacccaaagttatttaactactgacttgatgaaccagtatggtcaatattcttttattttattttattttactttatgttccaggatacagacgcagaatgtgcagatttgttacataggtatacgtgtgccatgggttgctgcacctatcaaccaatcatctaggtcttaaatcccacatgcattagctatttgtcctaatgttctccctccccttgccccccaccccctgactggccctggtgtgtgttattccccacactgtgtccatgtgttctcattgtacaactccagctgatgaatgagaacttgtgttgtttggttttctgttcttgtgttagtttgctgaggatgatggtttctagcttcatccatgtccctgcaaaagacattatctcattcctttctatggttgcatattattccatggtgtgtatataccacattttcgttatccagtctgtaattgatgggcatttgggttggttctatgtctttgctattgtgaatagtgctgcaataaacatacatgtgcatgtatctttataacggaatgatttatattcctttgggtatatacctagtaatgggactgctgggtcaaatggtatttctggttgtagatctttgaggaattggcacactgtcttccacaacagttgaactaatttacattcccaccaagagtgtgaaagcattcctgtttctccacagcctcaccagcatctattgtttgttgctttttaataatcaccattctgactggcatgagatggtacctcattgtggttttgattttcatttctctaatgatcagtgatgttgagctttaattcatatgtttgttggctgcataaatgtcgtattttgggaagtgtctgttcatgtcctttgcccactttttaatggggttgcttttttcttgtaaatttctttaagttccttgtagattctggatattagacctttgtcagatgggtagattgcaaaaatttgcccccattctgtaggttgcctgtttgctttgatgatagtttcctttgctgtgcagaagctctgtagtttaattagattccatttgtcaattttggcttttgttgctattgcttttggcatgttcatcatgaagtctttgcccatgcctctgtcttgaatggtattgcctaggtttttatccaaggtttttatggttttgggtttacatttaagtatttaacccatcttgagttaatttttgtataaagtataaggaaggggtcaagtttcagttttctgcctatagctagccagttttcccagcatcatttattaaatacggaatcctttccccattgcttgcttttgtctggtttgttaaagatcagatggttgtagatatgtggtgttgtttctgaggtctctgtcctgttcccttggtctatatgtctgttttggtaccagtaccatgctgttttggctactgtaggcttgtagtatagtttgaagtcaggtagcatgatgcctccagctttgttctttttgctcaggattgtcttggctatatgggctttttttggttccatatgaaatttaaagtagtttttttctaattctgtgaagaatgtcaatagtattttgacgggaatagcattgaatctataaaatactttgagcagtatggccattttcatgctattgattcttcctatccatgaggatggaatgtatacttgtttgagttgtctcttatttcagtatggtgaatattctattgaccaagtggatgaaacaggataaatcttgattatctgatgccacttcccatcccatctttgttctaataatcttctgcactttgaaaatcactgaactcattgatccaggtagtaaatagcataaacttcaatgtttggtcctaagtgctctaaatctgaacagaatatacttcattgttttcaagcaagtataaaaaaacagaatcctaaatacagatgtattcaattaatataatatcatttctgtagtgtttgtgttgctttagagacaacaaaaaaatatattaatattggactgattagttaaataaagctttataaatatatgagacttaacaaaattcaaacttgaccagatggaatgagctacgttgggaggtggtatatatcctacaacttgaggctttccagcagatgacagaatcccttttagcagagtgacaataaacaattaaaaactaaggagagccactactctatattgcctttaaaattacctttaatgctgattctgtaatattttcaaacttggccctctgggaagattaactcaaaaacatcagtttttaatttttttttttttttttttttttttttgagacagagtctcactcagtcgcccaggctggagggcagtggcttaatctcagctcactgcaggttccgcctcccgagttcacgccattctcctgcctcggcctccccagtagctgggactacaggcacctgccactatgctcggctaatttttttgtatttttagtagagacagggtttcaccgtgttagccaggaaggtctcgatctcctgacctcgtgatccgcccgtctcagcctcccaaagtactgggattacaggcgtgagccaccgtgcccggcctccgtttttaaattattattgtatcataagaagaaccacataaccttaaatttataatactgaccactcttaagtgtagagttcaatagtgttaagtatattacattgctgtgaaacacatacctagatgagtttttcatcttgaaaaactgaaactatataaccaataaacattaattccccctccctcatctctccagccctaggcaactacctctctactttgtttttatcagtctgcctactttagatacttcataggagtggaatcatacagtgtttgtccttttgtgactggcttattttgcttagcataatgccctcaaggtccattcatgttagcatatgataggatttccttttgttcctaaggctacatagtgtgtgtgtgtgtgtgtgtgtgtgtgtgtgtgtgtgtgtgtgtgtgtgtgtaacattttctttatccattcttctgttaacggacatttgggttgcttccaccacttgagtattgcaaataaggctgtgatgaccatggctgtgtaaatatttcttcaagatcctgctttgaattcttttggatatttacccagaggtggaattgctggatcgtacggtatttctatttttaaagttttcaagaatctttatactgttttccataatggtggcaccattcccaccaatagcatacaagcatttcaatttctccacatctttatcaacacattattttctgttattttgacagcaggcatcctaatgggtgtgaaatgatttttaattgtggttttgattggcatttccctcatgattagtgggttgaacatttttcatagatgtattggccatttgtatattttctttggagaattttctattcaagtcttttgtccatttttagttgtgttacttgttatttgttgttgagttgtagaagttcttcatatattctggatataaagctttcacatatatatgatttgcaaatacttcctccagttccattggttgtcttttcactctggtcattgttttctttgatgtacagaagtctttaagtttgatgcagtacaatttgtttttttttttttgctttcagtttcctgtgcttctggtgtcatattcaagaaattgttgccaaatccaatgtgtcctgacatttttctattagttttatagtttaaatattacattttctgtaggcattatagagtttaaagtcttacttatatctttaatccatctcgagttaatttttgtatatggtataaagtaagggcccaactttatcttttgcatgtagatatccagttttcccaccaccatttgttaaataaactatcctttccccagtggtagtcctagctcccttatttaaaataatttgccatacatgcaagggtctatttctgggatctacattctctttcactgatgaatatatctgtctttatgccagtaccacaccatcttgattactgttgctttgtagtaagctttgaaatcaggatgtctgaggtttctaagtttgttcttattctccaaaattgattaggctatttagtgtctcggaactaacgcttttaaaataaggatcatgggaagcatttaatgtaaacatatagagacaaagggattctcattctgctctcattccataaaacaaacaaacataaaaacattctttcccacagctgagtggcattcagaaaaagaagctcccttctaaatatcagaaagaacagttaccagaaaaatagagctgagctacaaaattcttgttaattagaaggtgcagctatttaacagagtataaatatacactatagcctaaaaataattaagagcaatgctgaaattctctaaagtacatgatcattctatcaaaatatactaaatgtattataatagaaagaactcataagttatttatttattaattttttttttttttgagatggagtctttccctgtcacccatgctggagtgcagtggcgctatctcagctcactacaacctccacctcccaggttcaagtgattctcctgcctcagcctcccaagtagctgggattacaggcacacaccaccacacttggctaatttttgtatttagtagagatggggtttcaccatgttggccaggctggtctcaaactcgtggcctcaagtgatccacccaccttggcctcccaaagtgctgggattacaccttggcctcccaaagtgctgggatcaccaccttggcctcccaaagtgcatgggctaccgcacccagctccacaaattattaatatctaatcagtctctcactttagattagggtttagattaggaaactgaggcatacagctagtctaagtgacttgcccaagaacattcaaatagtaagtgtataaagacaataatctaacatctgtttccagttatgacttactcttacacgattcttccttctcagtctgatatgtgtcctacagtcaaatgtgtttctaccttgttacctctctgttcttactgaaagaaacctaactttctgccccacccattgtggtacttgcatggtatttacttagtctcttaatcaaccagttttaattcataagattgtctttttcagcagaaaacagagtctagccaaagtatcaaacaactaaaacagtatctaaaacaaaatattcctgaaggcatttagtgctctactcatttctccaattgcatgcaacatctagagcatttacctatcaatcctttcatatataactatcccatttcatcctctttatattactatagtatagtaacaataggtataatctcattttatctcatttcaggcacaataaaaagtcatttaatgtgcctgaggtcacatgactaatttgtgatagagccaagatacaaatcctggtctctgactttggatcttttgttcattccattctatcacactgtcctacttttgatattacacttggttctcaacaaatatgccccatctcctctaaaggtattttcttagttgttcccataattgaattagtcaactctatctatccattagtcagctttcctctaaataaccccatttttgtgctgataccacctaactctcaatttacttagtcaccaagtcctgtcaattatttctttaagattcatcatttctctataagctgattacaattttcattgtttctcactaggactctggaatatcaaatctccaagctttatgctttgcatattaggtttatttaaacacagaagatatccctaaaaaatactcccaattattttaaattgttcaaaggaaataataggaataaaataaagaaagaaaccatattaaatatgaagtatttattcctcattaaaggtctaaagttttcattaatatctttttattttccaaatgttaataaaaatatcaactcaataaaataaatgcaaaacttgcaatttatttcaatagcatgaatatctactatttgccaagcagtactaagcatgttcatattgaggatcacattaaaatttcaaaagtaccctaaaagatgaggaaatggaagcttttagcatttaagcagcataagctagcaatatgctctccaattatgaaaacaagtttctctaatatatttttcagcatttatttaatttagctgcctggaaggttggcatatttgtatcccacttaggactaatgacttcattttcaggaagcaaaaatacaaatatccttgcgaacagccaggaagtacaaaaatgtgttttctaagtattcatgagcccatcatggatgcccaccctccctctcttcttttggagaaaaaaaaaaaaaaaaaaaaaaaaaacagtctcattgccaaattagataacttcctttcctggaagcacatttagtattttattactgtctcaaatagttaacatcttctaggttaaatgaaagtatttttcaagagaggaaaagtgaaatagcttacaaaatgactgtgtgataaccagcacttgaagactacgtactaaaacacagaacccaaaataaaacacacacaactactcaacgtgatacacattcagtgtcagctcagaagcctgagaacccaatatgctgaccaggccaaagctagaaattaggttacacattttcttttctttctttaacactactagcactatccacaaagaacaagacaagtcttacccatgaagcctagtaagaaaagaaaacagtataacacttacagttgtcgtctcatcagtttcattttcaaaactctgattttctttattttgctcaatacatgaagcattttcctttgatccactgcaatctgtaagctaaaataaaagtttaaaaaatcaatactccttttttattttctgcaatgtatattgttttcaaactttgaatatacacattaaaatatctaaggcctgaataaatattagatgttgcttatttcaattttagcatatgaatgtactatctaacccatttttatattgctcccaaagagaaaacataaaatgggacagttattcaaaggccaattttaaatttcaaaggtttccagcagggagtgttgaacatgggctattcaaaagtaaatggatgatctggttaaagctgagcatggttaatgggaagatgaagatagagggctgatttcactttatataagttctcatgcttggagaaatctctatggaagctattggagctctcagaactagcagtggcattgactgcctttgctttgggctgtctttttataactacagctttagatgataaaaataatgtctactttcaaagcaaagggtaggtttgcttactgaccattataaaacagatgttacctaaactgagggaacacaacctacaatatgacccattgaatatgactgtatcatgtgaccatctttgccttgcactgtaaaaattggggcttgagaaattggtacaagaagatgttgatagtctactgctgttgttgcaagtaattagtctctgccctacgattcttttggcagcatcgatgaaattgtggcagactaaattcttagtttgcaagtaggatacaatcttagactcctcacagttcttgagagtgacaaggatggaattctgacagattcatagtgttctggaagaggaaggatcagagacttctaggctgatgaaagggattcgtggaacatctttaggaactgggtagtaaacatgctgaccacactgaatgttcaactgcataataaggattcctcactttaggccaggcacaatgtctcacacctgtaatctcagtactttagaaggccaaggaggatggatcacctgaggtcaggagtttgagaccagcctggccaacgtggtgaaaccctatctctactaaaaatataaaaattagccaggtgtggtggcatgcgcctgtaatcccagctacttgagaggctgaggcaggagagtcacttgaaccagggaggtgcaggttgcagtgagccactgtgctccagcctgggtgactgagcaagactctgtatcaaaaaaaaaaaaaaaaaatcccctcactttaatgcacgttaatgaggagaaatttctaaagtggttgcaggctaggacagctcccaaatggtttttgccaactctcctctggctgggagaacttcctcaccaacctagcagtcggcctcagtttctaagattcactctaaaaggagtgggtgaacagaaatttccactccttttcaggcaatagctatagagacatgtacctgcactgattgtgacaggagagaaatttgcaaccactgtgggcagaaggatttctctgatactagtctattgtagactctcctcttctctgctcccgtagtttacatctatcattgtaattagcatattgtattataaattacataaatgtatatgtatatatatgtgtgtgtgtgtctacatgtatgtgtttatgtatgtttatctgtcccattagagtatcttgtaagacaagcaggatatcttactgtttttcagtctctagaataaatacatatttgtttgatgaatgaaaaataaagattaaattagatgaaaagttgatacatagatagatgaacaaactgagaagatgtgtcatctcatgaagagcagtttcaggctcaaccactttgggatacccaggtagcctctgtatcagaaacatagagctctttattttgtgctcccctctttgggccactcctctttggtcccatgaactatccaaataaatcagggcagtcaatctgactgtatctctcatgtagatgtacatagtaaggacctgtcctctgatgagacccactggaatcaagatgctgattgagcctgcactgtcaccattgctaattggatccatcatcatactgaacacggcggcacatccaccatcatagactaagcgcaaagtaaaagactgcttcccaggcaaaggctacctggttgtcctaaggtgattgagctcggcatttctcttagccagatcagagcccttattcattgtttgtacatttgttcatctatctatgcatctctttgtgatggttaatactgagtgtcaacttgattggactgaaggatgtaaagtattgttcctgaatatgtctgtgaggttgttgccaaaaagattaacatttgagtgagtgggatgggaaaggcagacttatccttaatctgggtgggcaccatctaatcagctgccagtgcagctaggatataaagcaggcagaaaaacacgaaaagattagactggcctagcctcccagcctacatccttctcccatgctggatgcttcctgcccttgaacattggactccaagttcttcagttttgggactcagactggctttccttgctcctcagcttgcagatggccattgtgggaccttgtgatcatatcagttaatacttaataagcacatatatatatatgtgattctagagggacagaatattaaggatgaagtcctttcattggtttgggggtttctggagttggctgcttaacatgattcgacccaaaaatgctaaaggctctacttctagtagtatggagaacactgatagtccttggcatgaactgtttagagagttatgcaagatgaatgcatttgacattcctgattcaccattcgtgagaggcaaggagtttagcgactctatacataatacatttgactatatgtggagaatcaaggaatataatgaagctggttggttgctcctgagttcagtggacaaagtgatgaaaggaaatgatgaaatcagggattctaaataccagcttcagaagcagatacggagcctcaaatctgctaagattaccctgagtgaaagtcttatctcctgtagagaaagatatgaaattgtgggaaaacagacacaagcccttaaagtgagggcactgattggaaaagaatgggaccctgcaacttggaatggcaatgtttgggaggtctctcatgaagctgggaacactgagtttgtaaactctgacgaagctttttttgccagaagaaacagctcccccattcccagtagtggcaacatcccctccccgacccattagcctttccaccgttgtctgaggagataaaccccgcactgcctgagaaaacagtgacaccctcccctgaggcagttgccaggcaagataatgttgattctcctcaggagccacccccaacagccctgtttgcttctagacttataactaggctgacctctcagtgggccctagaggtgaagttcagagtgtgacctataaggaggtacactatactcaaaaagaactacttgaattttctaatttatataaacagaaatctgaagaacaggcatgggaatggatattaagggtgtgcgataatggtggaaggaacatagaactggatcaggctgaatttattgatccggccccactaagtagggactctgcatttaatgttgcagctcgagtgaaaaaaaaggttgtaataatttgtttgtttagctgaaatatggattaaaagataacccactgtgagtgagctggaaatgcctgatctcctttggtttaatgtagaggaagggatccaaaggcttagggagattgggatggtggagtggattagtcactttagatctactcatcccagctgggaggtccagacgatacattcttgaccaatgccttacaaaatagatttgtgagggcagcacctgcatctttgaagggccctgtaattgttctactctgtatgtcagatctaagagtgggaactgcagtcactcaactaaaaaaaatttaaatacagtgtgaataatgggatcccgaggtggcaggggccaagcggtagcactcaacctccaaaggcaaggtaagcatagctaccataatggacagcagaggcaaaatggcaatcagaatagtctgactcgtgtagagctctggcactggctaattaatcatagtgtttctagaagtgaaattgataggaagcctactgcattcatacttaatgtatacaagcagaaaacttctaggtcaaatggacaaaagactaatttgaattataaaaacagaatcatggcccctcaatcaatttccacacttgagtcagtttacagacccagaaccccttgaatgaaggggagaccaggtccccttgaggaaggaccctactacactaccaacaatttatactgttaatttttctctctccttccccaaggagacctccagtcttttaccagggtatctgtgcactggggaaaggaaaatgttcagacagttcagggattactggacactggctctgaactgacatcgatttcaggggacccaaaaggtcattgtggtcctccagttaaagtaggggcttatagagatcaggtaattcatggagctttagcttggatctgacttacagtgtatccggactcatcctgtggtcatttctgcagtgccagaatgcataattggcatagacatacttgcaagctggcagaacctccacattggctccatgactggtagagtgagggctattatggtgggaatgccaaatggaaaccattagatctccctctacctagaaaaacagtaaatcaaaaacaatattgcatccctggagggattgtggagattagtgccaacaccaaggacttgaaagatgcaggggtggcaattcccactacatccccattcaactctcctatttggcctgtgcagaagacagttggatcttggagaaggacagtggattatcataagcttaaccaagtggtgactccaattgcagctgctgtaccagatatggtatcattgcttgagcaaattaactcctggtacctgctatgcagccattggcttggcaaatgactttttctccattcctgttcataagacccatcagaaacaatttgccttcagccagcaaggtcaacaatagacctttactgtcctacctcaggggtatatcaactctccagctctgtgtcataatcttatttggagagaacttgatagctttttgcttccacaagataccacaatggcccattacattgatgacattatgctgattggatccagtgagcaagaagtagcaaacacactggacttattggtgagacatttgcatgccagaggatgggaaataaatccaactaaaattcaaagaacttctacctcagtaaaattcttaggtgtccagtggtgtggggcctgtcaagatattccttctaaggtaaaaaataagttgctgaatttggcccctcctacaaccaagaaggaggcacaatgcctagtgggtgtacttggattttggaagcaacacattcctcatttaggtgcgttactcccgcccatttattgagtgactgccggttttgagtgtgttccagaacaggagaaggctctgcaacaggtccaggctgctgtacaagctgctctgccatttgcgccatatgacccagcagatccaatggtgcttgagatgtcaggggcagatagggatgctgtttggagccttcggcaggcccccataggtgaatcacagcagaggcttctaggattttggagcaaggttctgccatcttctgcagataagtactctccttttgagaaacagctcttggcctgttattgggctttagtggaaactgaacgtttgactataggtcatcaagttgccatgagacctgaactgcctatcatgaactaaatgctttctgacccatctagtcacagagtgggtcatgcacagcagcattccatcagcaaatggaagtggtatatacatgattgagctcaaggatgtcttgacggcacaagtaagttacatgaggaagtggctcaaatgcccatggtgtccactcctgccaccctgccttctctcccccagcctgcaccaatggcctcatggggagttccctatgatcagttgacagaggaaaagactagggcctggttcacagatggttctgcacaattatgcaggcaccatacccctgcatactacagctgcagcactacaacccctttctaggacatcgctgaaggtcagagtgaagggaaatcttcccagtgcacagaagttcaagcagtgtacctcgttccacactttgcatggaaggagaaatgaccagatgtgtgattatatgctgattcatgggctgtagccaatggtttggctagatggtcagggacttggaagaagcatgactggaaaattggtgacaaagaaatctggggaaggggtatgtggatggatatctgagtggtcaaaaaccgtgaagatatttgtatcgcatgggattgctctccaatgagtgacctcagcaaaggaggattttaataattaagtggataggatgacctgttctgtggacatcactcagcctcttttcacagccacctgtcattggccagtgggcccatgaacaaagtggccatggtggtagggttggaggttatacatgggctcagcaacatgcagttccactcaccaaggctgagctgcctggttatggccactgctgagtgtccaatttgccagcagcagagaccaacaccgagccctcgatatggcaccattcctcaggatgatcagccagctacctggtgtcaggttgattatattggacctcttccatcatggaaaaggcagaggtttatcctcactggaatagacagttactccggatatgggtttgcctatcctgcacgtaattcttctgccaagactaccctgtggactcacggaatgccttaaccacagtcatggtattccatatagcattgcctctgaccaaggcactcactttacagctaaagaactgtgattgtgggctcatgctcatgctcactggtcttaccatgttccccatcatcctgaaacagctggattgacagaacggtggaatatccttttgaagtcacaattacaacaccaacaaggtgacaatactttgcagggcttggccaaagttctcaagaaggctttgtatgctctgaatcagcatccaatgtatgctactatttctcccatagccaggattcacaggtccaggaatcaaggggtggaagtggaagtggcaccattcaccatgacccctcgtgatccactagcaaaatttttgcccctgttcctgcaacattacgttctgctggcctagaggtcttagttgaagagtgacaaactctgccaccaggagacacaatgattccattaacctggaattgccacctggacactttgggctcctcccacttttaagtcaacaggctaagaagggagttatagtgttggctggtgtgactgacccggactatcaagatgaaatcagtgtactactccacaacgggaagtaaggaagtgtgtgcgtggaatacaggagatccattagggcctctcttagtattaccatgccctgtgattaaggtcaatgggaaatgacaacagcccaatccaggaaggactacaaatggctcagacccttcaggaatgaaggtttgggtgactccaccaggaaaaacaaaaacaaaacaaaacaaaaaagcaaaacaaaaacacacaacctgctgaggtgcttgctgaaggcaaagggaatacagaatggttagtagaagaaggtagtcatcaataccagctgcaagaatgaggactgtaattgtcatgagtattccctcctacttttgttaaaaacatgtgtaagcatatatacgcttgtattaagaaaatatcttcattttatttcctttttcctttattatgtgacataaaatttattgacttcatatcagcattaaagtattgttaactttatgtagtagtatttgggttggggattggtgcatttccagttgtacaaacaatagttgtattatgttagatgtaattatggccttattattgtctttatttgaagattatgtatgatctcaggagatgtacgtgggttcaagttgacaaggggtggacttgtgatggttaatactgagtgtcaacttaattggattgaagaattcaaagtattgatcctgggtgtgtctgtgaggttgttgccaaaggagatgaacatttgagtcagtgggctgggaaaggcagacccacccttaatctggataggcaccatctaataactgccagcacagctagaatataaagcaggcaaaacaacgtgaaaagactagactggcctagtttcccagcctacatccttctcccatgctggaagcttcctaccctcagacatcagactagaagttcttcagttttgggactctgactggctttcctgtagacaacctattgtgggaccttgtgattgtgtgagttaatacttaataaactcccctttatatatattacacacacacacacacagacacacacacacacacacactattagttctgtccctctagagaaccctaatacactatctgatttaatcttttatttttttcattcattaagcaactatcttttgatctctggagacaaaatgacattaatatggactgcctgtcctctgaagaactctaattggccagagaaatataaaaatacgtaatttatattacatatatagatcatgataatagaaagtataggaggagcatctatattagactgtggaatcatgaaggcttcctgaaagatgtaacattgaaataatactgaagacaaaggaggttatctaggcaagtaggagtattcaatctaatagaaaatagtgtgggcttgaaaggcagcatgctctgaaggaaaaggcatagattttagagtaagaaagaaatggattaaaatcctttcacttccacctactacctatgtggaatggaggcaatatttaaattctatgactatcatcattgaaaatatggagatagtgccacccattgaatagggtcttcttccaccttactaaccaccctatagctgagttggatgccttggattgtaggggagaaaaaaatagctttcctctaccctcctacattctttggctgagctacaaattaaattgacataaggcagcttaactggagagacattattctaataacatgtgtacccatgtatgcatgggagtctcacaaaaatatgaaactcaaataagggacagaattcccttattccccagattgaagcttatttagcattctgagctacagaaagaaataagggcttggggtttctggggctggtgaagccaaattatagaaaggtgaggggaagaaatgtatagtgaataaaggttgccttgttatgcagatcaaagtctctcatctgataaaagttgtcatagactaactctctttctgacacaaatatctttactaatgaaaatctcctatataaatataaatttcctacataaaaggggagtttttcaatgctacttcagtgtctgtagtttcacaaaataaccagctttaaaaaaatcagtatgccacagaggaatatttggggctggtactctggtctcctatagtcatatttttgggtggcataccctgggccccagtgagatttacaaccttcctacctcataccagatgttgtcccatatatacatacatacaaagcactcagtctcaatatcatgactgattctctatttgtttatgtttccaccgttacttcatcccctgataacttgctgtcaattatgctctcatagaaatagtaaatttcttctatgcttctattcttccttcatttaaaaaaagaccctgatcacttcaaaactttaatctatttctgactttctcctccccagagtcaattctgttgaaagacataatagaagtagtaatagcaacaataaaaccgaatcatttaatgaaaagttacaataagctaggcctctcttcaaggatactgatatatattttatgtgcattaactcattagattaaaaagcatcttatgaagtaggcttatgatctttattttctgggtaagaaaacagaacctatttctgcctgaatgaaaagcctacataactaactaatatactaaactcctgagccactttcttactgcccacacatcctttcaaattgtggttcccagaccagcagcatcagcaccacccacaatgtcttagcaagatcaactcttcaacctactgaatcaaaccagtaggggtggggctctaaagtctgtgcttcgatgagctctccaggtgattctgacacatgctagtttgaaaacctctgatctagttaacaaatgttaaactattccaagttagcaaggtataagacacatttacgaagagatagatgattctcggcacaatggaaaattaatgcctgtctaacaagtgcagtctctagtcacttccaaacatttgttgccagatgtttaaaactatcaagagaacttagaagtctgaatttttatgtgaaatagcttgacttctaaatgttgacaacataaaaaaagaggttatgggaggccattgttttggactgagttccttcactaggccccaaaagaccagacgaaatcagaatggagtcattcatgctaggtatcacataatcaaactgacctttaaaatgggacagttttctaaagaacaagagattcacagcaacccattagaagaggccccatggccccatctaagtaaactgacctgataagaatgtctcctctgttttaactctataaggaaagtactttgaaatgaccagtctgctttttattccttagttctgcttctttcagctcctttctgcctgtaaggtcaataggctctgctcagctcatcagaacacctttctacttcatagatggaatgcttcctgatttcaacaaatttaatttaatgatcaaactggttttcaggaaattttgttctttgacagcaactatatatttttaaaatatcatctaagctaacatgcaataggccaaacaaaatataaacctgcactgcagtttccataagggcagccagtttgcaacctctgtattaatcctcaaatgctgccttctcttccctgaatactgaactcttaaaactcaccaagaacctcctagtcctcactgtcttcctagttctgtccaaatgaaaagcctgtgcagctaactactacactaaactcctgaaccacatctttactgcccactcatcctttcaaattgtggtccccagaccagcagcatcagcgccacccagagatttgttagaatctttttctgactttctatactcctcattatcttccactttctctgacatttcacacgattgacctcttcctccttcttgaaagttatacctatattcagaaacatctctctctcctatttgccacccaatctcttgaactctccttctctgtcatttcctcttcttccttttaactcctgaatcagctgttactctgaaattccttttatcgcttctctcactactcactactcaatgattcttcatctaggctttaggaagacattcttcccaatttctggtcctacattttcaattgcatgcttgtatttcctctaaaaaatcacactggtacctcaaatctgttctatctaaatgcaatcatttttttttcagaacccaatttggctacctggcttttggtaattccactacccaaatttcttaagaactatttatgactccctcctccacacagcctgtgctgatcctctttctttatccagctggatgggctctctcaatctataatgccttcaggaaatattcttctcctctacacctttaataatgattagtccacctgatctctttaggaacaacctagaatataaaaaaaaaggaaaaataaacttgtcattgcttatatatttatcttctccattcaagcagatttaaagcttcttcaacacagtaagtttattaccatcttgacatccttcatagtactttaacaaagtgaatgcccatagatattaagttgtttaattatgcagtgtttatacaagtattttctacattacacaatatgtatggacaaatatttgccaactttactttaaatgtattcatcttttatatacatatccgaaaagtttcctatataaaagaatattataataaacttagaaaaatctagatctcttttgtagagtaaataagtactcagtggtttaactgtttggtagattacttttttatttatttatattattttgctcaaacctagaattcttttctttggaaatgaatgtcagtactaatgagcatcatgtacaaaatctgtgtccttgcaggaaccaaaagccatataaactctaaaaatatatgttaaaaaagttaaacagagttctacgatgccaggtcactgggaagcactgccccttcccatcctctaagaatgtcaagtgtacagatcagcctgagtcagatcccagttgtactctggagtaatccaattctattaatatttcctgggtctcatatttatagaatgcctagtttacttaactctatactattctcttcatacaaaagaaatgttacaaactacagaggtatgaggtgaggaggagtctttaggtggggttcagaacatgctaccccaaaatagggcaatgtagcatttgagaaaacagcagaatcaggaagttcactctcactttcccgtcaccctgaagcaagtgataaaaccttcattccagaggaaccctcctaatacccagagggaaagaacatccttgtgctcaaagacacaaagaagacaagaagaacctgaacaaacaggccttaagtctgcctagtttattaccattagatcatatctcttttgccagtcatacttctgcatggctgcccactcttcatcaaattcagcataaaaatacacaggtttccctttttctttaggtcttcacttctctgtcatgtaaaacttatgttaaattaatgcatatgcttttctcttgttaatctgtcttttattataggggtcttagccatggacctagcaatggataaggaaaagatattacttttttcccctacacttttattttacagaaaacagcatgctaccattttatagactacttcaggattacaaacaatgggtaagtttaaactaagtagttctcctctgctgaaataataataaacttcactctcttagcctaaaggcctcaggattccttgaaaaaactgggcacagacaaataaaactaggcacaacctaggagttcaagagaagagagtatcagttatcaagaaaagtgtccaccttatttgttgattcaatatacatgtattaaattgtattacatgcaaagcactaaagaagatgttttggggaaaacacaaagaagacagtgtccaaaaagaatttagtgtaagaaaggaaacaaatatatacaaaagtcactataaaaccatgtggaaagatttgattgtcaaaaatgaagtgcagacaacatgctctgaaacttcaacagaggttcagttcaataaacatttattaaatgctcaatatgccagtcctttaagaaatgtagagtgaaataagtgaaacaagtatataagcagataatttcaatttaattttgaagtattataacagaatgatatagttggacaactacatttttgccatcaaatagttgttagaaatgaaatagaaaaggtaagcagaagccaatttaggagaatcttagacattatgccaaagaattcagattatcccaaaaaatagggaatcaaagaagggttgaggtgagaaatgatagggaagagtagaggggtcaaatgggaaaacattttaaaagtaaagctctcacagacttatttattattttacatttttctttgatttttaaatgtattcaaaataacttaaagcttataaaaattttgcagaaataggacaaaaaatatcatgtacctttcacatgcatttccagctatatagttgtttatggtagctggtcttatctagtaccaggtacttcattatgtcaatgtcttcgtcattgcaaacctttaaaaagtctggctgactactatgcaggtatgcaaataataaaaaaggtttctataaactaacagaatttttttcaggatacactgttaaagtaaaacaagcaaagtgctaaagaacacggtcatcccctcagtacccatgtggagttggttccagaaaccttcacagataccaaaatttgtgtatgctcaagtccctcatataaagtgaagtagtatttgcatataacctacacatatcctcccagatacttttaaacatctctagattacttataataccaaatacaatgggaacgctataaaaatagttgttgtactgtatttttatttgtattattttcattgccatactgttatttttattgtcttttaatattttcgatttcaggttgattgtatatgtggatgcagaacctgtggctaagagaagttcaactgtgtctataatatgctatcttccgtgtaagtgtaggggcaaaggaaattttccgctccctctctgaaggttccagtttgctaaaataaactgataacatgaaaaacggtacgtaaatgtattaacatgcaagtgtgcacatacaaactatgtatgagccatacaaaattgaaacacaaaaaaggatgagatggctaatgcttaaatagcaccctcttcatagaggacaaggagatgagggaatgtaggcaatttttaggggtagtaaatgatttttaggagagttgattgggcccaaagaacagatcatcatttgtgaattgctgtgtttggaaactgaatgggaccttaagaacagacaatagtttgtgacattctgtctagatatgtaatattcctcagtctttcttcctgaaatatgagtttactcctctctaaataataaaatttcagggaaggtatccaaagcaattatgttccttctggagtagcttcagataaagaaccttcagagagttcgaccctgtgcttgggaagagacacagaaggtcaaaaagtccttgattctgaggccttctaatttcctttaattcaagtgctaagcatgtcaaagagctatacttttgggtatcattttctaagccccaacataagaaagaagggaaaataaaaacacatacatgtatcttatttgtcctatggggggaaaagtttccccaagccacctaggattcctggctaagcctaaaaataggagaaaagcacataattttaattcaataaaagtttatatattacatggcagcgagccatcataaggaaatgaagatccaaagacccaaggaaaactgtattttaaaaaataaatctgataaaagcagtgcagagttgtgaagaaacatgactggacaaaaaggggtatgatctaatggtaatagactggagggacaggggagaggagaaggaacttcagtaaggcctgtttgttcagattttttcctgtgtctctgtatgacattctttccccccacatatacagcaggatacttgcctcgtaagaacctttagggtaaaagggaggccagagagtgacctttccaggtttcatgcttgctttggggaagaggaattctagtttctatgactcacccaaggggagagtaattctgctttctatgactcagcttgggcaggaaaaatagtggggaaaggtgaatagaagaaagtcaaagaaactctgagccccttacaatctccttcagttcaaagtactcagcatgacaaagtaccataatttgaggtatcatgttctgagcccaacactacaaaattcaagttaggaaggttaaataatgtcccaggttggcaactatctgaggctggtattgcacaggtggtaaaaagaatttaccaagacagctgtacgtaaagaaaggcaggtttgagaaagtaggaaaatgcattgcaagaaaacaacaggtaggtcagcaggagaggaggtgactgacaggagagagagacttgctggggattttataggatgatgtttgtgctgtgtgctgaagagggctttctctttttgctttcccttggtcccaccagcccaactccccttctctaattaggactccacaaataaggcataacaaataaaaaaaaaaaacaggggagaagggaaagctcttccttacaggaaaatgtcaacaaatacacgtagaagaaatgaggcaatcagaaaactaccaaccggaagacaccatagtaataattgtttggaaaagaaggtgatacacaaaatatttacctaaatgcaaaatatctcaaggggtgccagataagatagccaattagaagcagctgcagtctgcagctgtcacagggaggagtgaaaacaggaagcgaattctgtaccttcaactgaggtatccaggttattgcattaggactgactaggtagacagctggacccatggagagtgaggaaaagcagggtgaagcaatggcccacggagcagcacagagccaggggaacccccacctccagccaagggaggtggtgagtgattatgcaccctcatctgggaaaccatggtttccccatggatctttgcaaactgtagatcaggagatcccctcgtgagccaatgcgaccagggccttggatccgaagcagagagctgtgtggaaactccacataatggccactggggcatgcacagaggcccaagggttttgtataatctggccctgggaattccagtgaggtgggagatccatccacgcattacgctaggaagggggctgaatccaggagttaagtggcttcattctgtgggccctactcctacagcaccttacaggttaagacccactggcttggaattccagccagccagtggcagcaggctggagactgcctgaaacagaccaagttcctggggggaagggcagccaccatctctgaagttaagagtgggccattctaccctgccagctccagggagtccaggctgtctggactggaaggagttccccacaatacagcatagctgccatgccagatcatggccagactgctgctttaactgatccctccctcctcactgggtggggcctccctgtgggaattacagcaacttcagccaagtttttcagacagaactctgatctctccctaggatgaagccccagggggaagtggccactgtccctgtggttcagctggcttagatgttccagcctgctggcactgaagagtccgggcattctggacgagggggggttccgcccagtgcagcacacctgctttgctaaggggcagccatactgcttgtttaagtgggttcctgaatcccttcctccggactgggtgagtcctcccaataagggtctccagacgcctcctacaggagcgttctggccagcatcaggttggtgaccccctgaaatccattagctcccagaggaaggagaaggctaccctctttgctgtttcacagccttcactgatgatatctccaggtgctgaagggaacaaggtgaccagggtctagagtggacccccaggaaactgcagcagctctacagaagagtggcctgaatgttaaaagaaaaacaaacagaaagctacaacaacaacatcaacaagaaagaccccacaaaaaccccattcaaaggtcagcaacctcaaagattgaaggtagagaagcccacaaagatggaacagaatcaatgcaaaaatgctgaaaactcaaaaagccagagtgccttttctcctccaaatgactgcaatacctctcctgcaagggcacagaactgggctgaggttgagatggctgaattgacagaagtaggcttcagagagtggttaataatgaataacaaactttgctgagctaaaggagcatattctaacccaatgcaaagaaggtaagaatcatgatgaaacaatacaagacctgataaccagaacagctagtttagtgggaacataatagatctgatgaagctgaaaaacaacacaagaatgttacaatgcgaccacaagtatcaatagcagcatagaccaagcagaggaaagaatctcagagcttgaagacaatctttctgaaataagacaggcaaaaaaaatagagagtaaagaatgaaaatgaacaaaccaaacctctgagaaatataggattacgtaaagtgaccaaacctatgaatgattggggtacctgaaagagacaaggagaatggaactaagttggaaaacatacttcagaatatcatccaggagaacttccctaacctagcaaatcgggccaacattcaaattcaaaaaatccagggaaccccagtaagatacccaacaagaagataatccccaagatgcataatcgtcagattctcctaggttgaaatgaaagaaaaaaatggttaagagcagccagagagaaaggccaggtgactaacaaagagaagctcagcagactaacagcaaacctctaagcaaaaaccctacaaaccagaagagattggggccaatattcaacattcttaaagaaaagtatttccaacccagaatttcatgtctggccaaactaaactccataagtgaaggagaaataagattcttctcagacaagcaaatgctgatgtaatttatcaccatcaggcctgccttgcaagagttcctgaaggaagcactaaatatggaaaggaaaaacccattaccagcaacaactacaaaaacacactgaagtacacagaccagtgccactatgaagtaaccacataaacaagtctgctaagtaaccagctagcatcatgataacaggatcaaattcacacataacaatagtaaccttaaaaataaatgggctaaatgttccaattagaagacagaatggcaagctggatagagtcaagacccattggcgtgctgtctttaagagacccatctcatgtgtaaagacacacataggctcaaaataaagggatggaggaaaatttaccaagcaaatggaaaacagaaaaaagggggttgcaatcctagtttatgataaaacagactttaaaccaacaaagatcaaaaaagataaagaagggcgttacacaagggtaaagggttcaattcaacaaaaacagctaagtatcctgaatatacatggaccaaatataggagcacccaaattcatgaagaaagttcctagagaactaaaagagacttagactctcaaagaataatagtgggagacttaaacaccctactgtcaatgttagacagatcaccaagacagaaaattaacaaaaatattcaggacctgaactcagctctggatcaagtggacctgataggtatctacagaactctccaaccaaaaacaacagaatatatattcttctcataaccacacggcagttactccaaaattgatcacataaatggaagtaaaacacccttcagtaaatgcctaagaggcgaaataataacaaacagcctttcataccaaagcacactcaaattagagctcaagattaagaaacttatttaaaaccacacgactacatggaaattgaacaacctgctcctgaatgacactttggtcaaaaatgaaattaaggtagaaatcaagaagttctttgaaacaaatgaaaacaataaagtatcagaatctctgggaaacaactaaagcagtgttaaaagggaaatttacagcactaaatgccacattaaaaagctagaaagatctcaaattaacaacctaacatcacaactagaagatctagagaaccaagagaaaatgaaccccaaagttagcagaagacaagaaataaccaagatcagagtggaactaaggagacagagacatgaaaaacccttcaaaaaagtcaataaatccaggagctgattttttgaaactattaataaaatagatagacactagctatactaataaagaagataagagagggcagtaaaatagacacactcagaaatgataagggggatatcaccgctgaccccatagaaatacaaacaaccaagagaaaactataataaacacctctatgcacatcaactagaaaatctagaagaaattgataaattcctggacacatacattctcccaagacagaaccagggcaaaaattaaagccctgaatagaccaataacaagttctgaaattgaggaaggaataaatagcctagcaaccaaaaaaagcccaggaccagataaatttacagctgaattctaccagaggtacaaagaaaatctggtaccatttctaatgaaactattccaaacaaatgaaaggaaagactcctccctaacacattttatgaggctagcatcatcctaatgccaaaacctgatggagatacaacaaaaaaagaaaacttcaggccaatattcctgatgaacatcgatgcaaaaatcctcaataaaatactggcaaactgaatacagcaacacatcaaaaagcttatctaccatgacccgacagttggcttcatccctaggatgcaaggttggttcaacatatgcaaatcaataaatgtgattcatcacataaacagaactaaagaaaccacgtgattttctcaatagacaccaaaaaagtcttcaataacattcaacatccttttatgttaaaaactctgtataaactagatattaaaggaacatacctcaacataagagcaatacatgacaaacccccagccaatatcacactgaatgggcaaaagctggaagcagaacccttgaaaactggcacaagacaaggatgccctctctcaccactcctattcaatgtaatattagaagttctggccagggcaaacaggcaacagaaggaaataaagaataatcaaataggaagagagaaagtcaaattatctttctttgcagatgacataattctatatctagaaaactctgccgtcaccacccaaaagtatcttaagctgataagcaacttcagcaaagtcccagcatacaaaatcaatacgcaaaaatcactagcattcctatacactaacaataggcaagcagagagccaaatcatgaatgaattcccattcacaattgtcacaaagggaataaaatacttaggaatatagctaacaaatgaagtgaagagcttcttcaaggagaactgtaaatcactgctcaaggaaatcagagaggacaaaaacaaatgaaaaaacattccatgctcatggagaggaagaatcaatatcgtgaaaatggccatactgcccaaagtaacttatagattcaatgctattcccattaaactactattgacattcttcacagaattagaagtaactgttttaaaattcatgtggaaccaaaaaggagcctggataaccaacacaatcctacgcaaaaagaacaaagctggagacatcagactacctgacttcaaactatactacagggctacaacaaccaaaacagcatggtacctgtaaaaaagaagacacctagagcaatggaacagaatagagaactcagaaataagacggcacatctgcaaccatctgaccttcgacaaacctgataaaaacaagcaatggggaaaggtttccctatttaacaaatggtgctaggagaactggctagccaaatgtgaaaaattgaaactggaccatttccttacacaatatacaaatttaactcaagatggattaatgatctaaatataaaactcaaaactatgaaaaccctagaagaaaatctagatagtaccatttaggacataggcactggcaaagatttcataataaaaatgccaaaagcaattgcaacaaaagcaaaaattgacaaatgggatctaatttaactaaacagcctctgtgcaacaaaagaaactatcatcagagtgaacagacaacctacaaatgggagaaaatttttgcaaactatccatctgacgaaggtctaatatctagagtttacatggaatttaaacaaatttacaagaaaaaacaactcaattaaaaagtaggcaaaggacatgagcagacacttctcaaaagaaggcattcatgcagccaacaaatatatgaaaaaaagcccaacatcactgatcattaaagaaatgagaatcaaaaccacaatgatataccatttcatgccagtcagaatggcgattattaaagtcaagaaacaacagatgctggcttggttgtggagaaaaagggatactttacactgtgggtgggagtataaaattgttcaaccattgtggaagacagtgcagcaattcctcaaagatctagaagcataaatgccatttgacccagcaatcccattactgagtatatacccaaaggaatataaatcattctattatagagataacatgcacatgtatgttcactgcagcactattcacaatagcaaagacatggaaacagccgaaatactgctccatgatagactgaataaagaaaatgtggtgtgtatgtatatgtatttatatatatatatatatacatatacacacacacacacacacacacatacatacataccagggaatactatgcagccataaaaagaaacaagatcatgtcctttgcagggacatgggtagagttggaatctgttatcctcagcaaactaacacaggaacagaaaaccaaataccacatgttctcacttataagtgggagctgaatgatgagaacacatggacacatgcaggggaacaacacacactggggccttacagtgggtggcagagtgagggagagcatcaggaagaaaagctaatggatgctgggcttgatacctaggtgatgggttgacctgtgcagcaaaccaccatggcacacttttacctatggaacaaacctacacatcctacatatataccccagaacttaaatgttgaagaaaagaaatagtgtctcttatgagattcttattaactactaaaagaaaatagtaactttacagtagataatctggaagctaccttaaccaagtgaacaatgcataatcagtaatttaacaaatatatattttaaataccttctcaaatcatgtaatgagaaggatatatcccttttgtagtacttctgccaaaaatatataacttgaatttaatcataaggaaatagcagaaaaaaaattaaaggctattttacaaaataaatgtcttatatttggggaaaaaaataaattcaaggtcttgaaagacaaaggtagactgagaaatattcttcattgaagatgactaaaaagacatgaaaactaaatgcaatgtataacactagatcagagcctggaccagcaaattttttttataataaagacatttagtggaacatttaatacaattttaataagatctataagaatagacaatatttagaccaatgctaaattcctaattttgatcattgtaccttggttatacaaaagaatatacttggttttagaaaatacacagtgaagtattcagggaaaaaaggcaaattgctctttaaccacacccccaaaaaagtatgcatgtgtttatgcctaaagagaataacacaaatatagtaaatgttaattttggagaatctgagtaaaagttatacaggttattttttactatttttgtaacttttctttgttttagattatttataaataaatagtttttaaaagaaagctacagatccaaaaatccaaactgtttgaagaaagtattatactaaaactatagcaaaattagtaatcagaatgtaaatatgtccaatatgaatataataaaaggaatgaaaaagatcttcaataaacagaatgctcagagatagaagaaaatacaaagtcaattttttaaaagccaaacaaattatgttggaaaacaggaagagagggaacaagaggtagaacaagacagatataacaaagagccattaaaaatggaataaaaaatagtcattgcaacaaaaattaatagatattataaaccatagactaaacatatgcagaaaaattggaagatagcacaagaaatcccctcagaacacaacactaaaatgctgagatctaaaatagataaagagctgtacaaaagcatgaagaatagattgagagggtccaatatacatcttctcagagtatcatgaaaggaggatgaagagaacgctgaaaaagcaatatttgaataaatacagctgagaattttccaggatttcaaaaagagatgagtccaccgatagaaaaagctttctaagaggcagtgtacatacataaaattaaatatgcactcagacacacaagagtaaaactgaaaatcagcaggaataaaaaggaaatcttaggatctacaataggaaacaatctacagaaaaacagcttaattaagcagagaaaccaaaagtaatagaacatatgctcacagtgccatgagaaaataattgctgtcctataagcttatagccagctaaattatcatgcaaaagggagagtgcaagcatacaaatattaagataatttaacaataaatatcctcacaacaataattactaaaggacgtacttcagcaaaaagaaaaataaactcagaggaatatctaagtacaaagataaatagtgagcaaataaataaataaaatatatcataagtcaaatatgaagtattgtatggatatgagagactggagtattcaatgagttattaaaatccatcaaggtccttgtcatatttgagaaagataaatataactttagatttcttagaataatatatagattattatgtatgccaaaaagataaccaattaaagaacagaagacaatcagatgtttccaaccagcagaggaaaaaataagaagaaaacatagaaaaattttcagtacaacaggaggtacaaatgggtgggtgaaggagaaaggaaaaggatggtcaatgaacaatgtccttaaatggcggaataagtctaaagacattaggacccacaataatacaaatgaactaaacctatctatttaagataggtagcaaactgaacaacataaatgttaataacggtagttaatacttcctattctgcaagtgctttacaaagattaactcactgagtcatcacaatagcctatgaagtttatactattagtgcaccattattatggataagcatattgagatttaaagaattttagcaaattgtccaaggacacacagctagtaggtggctgtgatttacaccaggtaggcttattccagagtttaacctttgtgaccattctattctgctaagactcaatatagtcatatgatcaaaagttatgtattattaaatattatactctagaagaagctttatggatgtcaaaatgccagcaggattattttaagtgaaaaagtatgttataaaagaatatatactaataccatccaaagtttgattaaacacacacacacataagcacatatacatactgagaaatccaccagagaacagttgtaattacttctgaatcttgtgataataggtgacatttattctgttctttatatatttctgtattttctacagtgcataactgtatgtcattttgttaaactttttttaatgagccttgtacagtgcctggcacattaatgatcaagggagagagggcaaaccacaaagtcctttcattaactaaagttgagtggaagctacagaaccaacgatgttgtgttatcttactatcacaagctcagatcctagggacaaataaactgcatacttaataaaaagattcagcaacgagaaaatcctaacaagctgcccttttgtgttagtttcaggatgtgattttggaatccaacctcaattgtggcttcaaaagaaacctgaaaataaaagcttcagctgtagaaatgcagttaaatatcagcattaaatagaacatagagcccaggaatgtcagagctgcaaatgtacttatggagattgccacctacagactaaatctctcacttatacatcaggggaaaagatccacaaaagcagagacttgtccaagtttacatagactttcatagatgaacccagactggaactcagtttttctgtcttggataaagaaactgaggtttctgacatgaattacttgcccaaaattacacagctaccaaaaggtagagccagtattctaatttggtttgacaggattccaaaatccattctgtttctgaattataatcaaatagacaattttttaattattcatagaaatcttatttaatcaacaaatttatcaattgtttattatttaatattcttcaagaatatgaaagtattgaatattattcaataatttttattcacctagcacttccattttactagcactaaagaagaaataatttctctcttctttcaggcttcctcttcctgttgcttgaatatctccttctctccatatatatgtatatgtatatgtatacgtatatgtatatgtgtatatatatgtgtatatatgtgtatatatatgtgtgtatatacatagagggagaatcaatccatcacctcaagcatttatcctttgtgttacaaacaatccacttacacccttttagttattttacaatgtacaattaaattagaaaatagatatttttaagttactatgaattggagatggagttttttttaagaattttccctgtgatctctttcctttttaattttctatgacttactctctgaaaagcccaatacttttagaaagcaggtgtcatgtcatataattgcagttctccttttaaaatttaattttgtttccgttcccttgttattttttccctgtcaacactaccaatagttgcactcacaaataggcagtaacccttgcctgcatgcctagtgctgttttcctgtattcattttgcttctgattaaacacatttgtattaagagtgtacttgtagcacagccactttctacatgaaaggagaattttgttgtggtgatgaatattgttttccagtagataaaataatttctaaatatcttctctattagctcgatattttcaaccaggcttcatcctagataaaagatcctaactgaatgtagcaggagatcatcgtcccttacaggcttccaggaaatgctctcttcactgtcaattatttatattgtgaacatccaggcaaggagactgcatagcattctgcttttgtatttttcaaatttgcctcatctttgtgatgtggaaatttgtatggtgatgaagaaagtacacattcatctaatgagtgagaaataaatagtttttattttttgaatacattttggtagttggggttagatgtgatggaattaatgttttgtctctaatgtcctaggacctagtgtaggacctatttattccaagtactctgcctatgttatcccaattcattcttcacaaatatcttacgagggaactgtcaacccattttaacatgaggcttagagtagttaagtaacttgcctgaggttgcatagctaagacatgatggagtctgaatgtaagaccaagttgtccttgtgttctttacactgaaacacacttctcttcacaatctaaacatgttaaagtgatcaagtggagaaaaagaatgaaataagaattatattctttattcagcctgacacattttaattggcaaggaaatactaaatcagttagttgttctagaattgaaccacttacattataatttttatttaagaaacacaaactgctttttaaaaagcaatgaaaggctttagaaatgtatcagttttctaacataattatttgtctgtgtgtgtgagcaagtgtgggagaaaagaaagagaaagagaaatggggtggggtagacttatgggcacgcctgtgtgaacacacacattcagctattattctaaagtggaaatcactccccagcaacatattcagaaatttagctgggagatagaagggtaggaagccacaaaacaacatttaggaaattactagcaaagtaaaaatcctggtgattaaaaacaaaaagaaaaaaaaggggaggcacaaaagacacttgaaaccaagtgcaacaagttaccatggcaactagataatgtgggttgagatttatatgactccattgttccagcagagaaattctaaatgacaccctagtggcctgacagagtcgatgcatctcccagaatgctccggcttattactcaagagtgctttaggcacagagaaagaacaagatcacagtaactttgtcagttccagccttcctaagacacttgtttcttcattctggaggcaaaacattctcaatttctggagccagtcctgaccaagcttagcagaatattagcattcttatatttacctgtggttgaggatagcatttaccttactgtctgaagtacgtgatccagtatgaatggaatcagctttgggcacctaaatccctctttgtttttctgctggaacagtagtctgccctgattcccaggcaactttagctaaggctctaaaattctgactaatcattaccattgttaattaacaacaccatcagcacaacaatctagtattcataacaaatatttgttgaaaatatattacctctaatgctaattaacaaaccccaaagtagttatcatctatagatgctcatatgtttttattactttgctacacatgaatggcaaactgaggctaagaaaacttaagtgaccaaggtcccaaaacagccaaaatttgatttcagaaatgacaacaaaaccattgccagggggatttatcttactacatcaaatcttggctgtggttgggtccaggtccaccattttaacataaacactaacaggaataaaagacacacagaatattatggcttggtcctgttgtaccccatttactgcatgggcaggctgagatatcagggacagcaactccagtccaaattaagtccaaattagccatgctcctattacctctgaatattagatcactagttgagaaaacaggctgccctatttctaggttcattatcttagctggaactccatccgtttcttgcttctcactctttctcactgaccctcaatggaaggaaaaaataaaaaaggaggaggcaattaagatgtttaagcatctattatgtgctgggcactctatttgaatatgttatctcattaaattcctaccaaaaaatctataggctaattattttcctttctgttttacatatatgagaactaagaatcagcagataaataatttccaagggttatacagtaattattagggtttaaccaagtttctttgaccctagtcccttgccttttgtcccttaacccttggcattcctctcaacatagcttgttcagattataattatgtttagagctggaagggaccagagcatgatcaattttaagagatgtaattagtcaatatgaaagtactattaaaagtaatcaaaatagagaaaacagtaggagttagctgcataaattaaaacaaacttatgcatagccttatatcctccaatatgtaattctaaacaaggggatttttttttataaaagagattttcctttttttttttttaggaacaggtgtgcatagattaggaatttctattatgccaaggtttcattcgttgcaataaataagctcccattttgtagagaaacaaggtagttaataagcaaaccagtaatggcagcttttggtgtgactatttcctgataccaccaagcagtttcctccaagtgagactagttgaagccatgcttggagatataactgttattagaactgcccatttccctcatttggtacagtaaaggttagtttcttccctcagagtggaattaggtaatcattagccatcttccatgtcacagaggtaatactattagggcataaattaatacacatagttaaaattttaatataaacttgaacagtattagaagttagaccactatttttcatgttacacttctgtaatatgaacttctttggaaaaaaaaataaaagcaagttaccagtttccagtagagcaaaatgtgaataaatttaacaactatactgtgttatcatagcaaccaatttaaaaaaaaactgatatgataaaaaatgacacaagagaacaaatgtatcaagttgttatggcaactggggaacgtgggttgaaatttatgtatctagaatccaagagaatattctaagcaactaaaataaacatttgcttattaaaacatcccccaaatagcacttacctataagcattgaagtgttttcattattttgtctgctttttcttttatttccaatggatgattttatattgtgagcatttgtattttcagttcagcttactttttggcaacagatacaccaagatgcagtttggtttgcagaaaatggtgcaaaagccaatttcaaaatagcatcctcaatcatgttttacccttttactcttctcttaacaaaatgtctattctatctgctttttctttataaagaagctcttgcttacttgatcaatcaaattcattatgttatctttacctgattttggaagtcttcccattagacaggatatgggttaaagaattatataataaatttggatatttaggaagtcttccactaatttatgcacgcacacttttcttttagtagcataactggttgttttggactaaatgttctaatggcatctgcagtttctacagaactttgcccatgctcatgtagagtatctcattgtgagagcaggaaaggtgagattctctcatgactccatgcatttttgtaaaaccttttcccagtgccactaatactcttttttccacccttctatctgcttggctgattcttaatcataactttccactgtctacccatttgagctaagtgtccctcacctttgtcctcataacaccctctgcatacttacagctaagtgccatcatcctcatcgaaatcaacataattaacataatcattatcacatatattacatattaagcattatctgtatgttagtgactgctaactacttcccaaatatcatttcatttaatcttcacaaaagccatgtaaggtagatataattaccgccacttctctatttcataggtaagggaaaactgaggcctagagtttgtcacttgatttaggtcacatactaagttacagccaagagattttaatccatgtcaacaaaataccaaagctcatttctttatcatttagttagtcactaaaattttttctttagtttgttttgacattaaactatgaactttttgagaatttccatgtgcctacactgtagattttctgaacacatgtcttatctctggtatctcctgcactgttaaatagagacataatatgaaccacaattgtgagccatagtaaaattttgtattttctagtagctgtattaaaaaagtaaaaagaaacaaaattaatttaaataatatatttcatttaactcaatatatgcaaactattaccatttctacatgtaatcaatatataattattaatgaagtattttacatttcttttttagtactaagtctttgaaatctgttgcatattttatatgtatccaacatctcaatttacacatgcagctttagtggctaccatattggacagagcagctttaactcatgcctgataagtagatatgtaaagaatgttcaatacaagttttgtggaatgaataaataaatgggcaaatacatagaaatggagaattttagatttgtatttatagaatgacccaatttacctttatggaacttttaacagtttgtttatgaggaagctaaaagtggctattttaagacagaacatagatacgtagtagtgtattcatgttgtgataattccaggattactgtcacatcctgacctatcatggagaattgcctgcccagacacttgtgtatgctgaaatccatagcggtgtatcattagtcagctcaaaaagcctcccatttttagaacatgtgttttccattctcaggctcgggtttcaagttataattcatcatatatttcattttaaaaactcctttagatcattttaatcaatgcctattaacagtaagttaagaatatacattttaaattaaatcaaaatcagcccatatcgataatgaataaataaagtatatctcagagtatcccccttaaagaatatttttatattaaagccctggatgtgctgacaccacactgaatattactggtagaaataatcaacattttaaaaatccatttacatgataacagatatactgaacattgtaatatctttgcagtcaaaaaaccaacctcgaaatcacatctcagtggcaatactgaatattactaaaacactggcccaggggggaaatctatagaataaaaccggcaattgctaagactttacataataaaattatccttgactaaaaataaaccgaagaaaaacatcagggaatgagaatatggtgattactctagaaaactttaaaaaattcttcagaatacctatatgaaaagccaaagggggagaaaagaacaaataaaaatatggctgtcatgacctaacggttcattgcctattaggatgggacccactgacttatcttacaagggaactgccaattctgcttttaatgttattaatttgagtgctaactataatagacatgattaaaaatatatcgaattagaaaaaaaaggaagtataaaaactagacaaaattgctaaaaataacaatttcaggactctgggaaatgaccaaaagtgtacaacaaattgagaaatgtttattcatgaaaaactactcaactacaggtaagagagtggaaattagtgtcagcgttgactgggcatgctcccatctccactccatccagctcagtttgctagttctattaggatgggaaaagtagtaagaaccagtatctttgcagcctaagggaactcgcttgatttggagtggaacatgagaaaaaaatccacactcagtggcattggcagtaacagtaacagtctcagtggcaagcaaaaggaataaacagtggctccagtgaccttaggttgtagtgctggttggggcatgcaaaacatcagcagactaattggtagttcaacaggaagatccacgaaatgagacggccataaagggccttgataagctattcacaccaccctgctgatgggaaagtcttaaaactgttcaggagagattagagaaggccttagtctctctatgtgtccctggctgaatataatccacaagcgcagaggagacatgggaatagaggacctaaagagagtaaaagttggcaatggcttgtaaactacttgaactatgaatggaatccccaaaccaaacacagatccatcagtagagggtggaagccttgctgattcaagatatttaggcacaaactctaaccaaatattggctgaccactaagctatgctgacataggggtgacccatagaaagccaggatttcaaacaaaagtaaatattaaaatcctgcagggaaagagattacatagattgaatgcaggaaagttgcaaacaaacaaaacacaagcaataacaaccatcagagtgggaggcagaatctagatttgctataatctggtatctaaaatgtctagtttttttaaaaacagacaagcaaagaaacatgaaagcgtgatccatgctcaagagaaaagcagtcaacagaaactctcttaatgaatacacaatagacctaacaatgactttaaagcaaatattacaaatatattataagaattaaagcccatttttaaaaaattaaagtatgactataatgactcaactaacagaaaatctcaataaaaatgaagcaattgttttaaaaatttaagtggaaattctgaagtataacatttaataactgaaatttaaaactcactagagagactcaacaacagttctgaaatgtcagaagaaattatcagtaaacttgaagattagaaatgatctaacctgaagaacaaagagaaaatgaagaaaaattaacagagccttggagacctctaggacaacatcaaacacaccaacacaagtaacgggagtcccaaaaggtgaaaacactgggaaacagacagtaaaaataagccccaagcttttaaaatttgataaaaactgctaatctatagatccatgaaactgaacaaaaccagaatagaaaaaatgcaaagcaatatccatctaaatacatcacagaaaaactgttgaaagaaaaagagaaaatttttaaggcagcaagataaaaaatatgactcattaagtacagagaaacagcaatatgattaatggctgacttcccataagaaagaatggtggctaaaagacagtggaattatatatcaaagtgcttaaagttaaaaacaaaaacaaaacctgtcaaccaaaacctcctcgggaaaattattcttcaaaaaggaaaacaaaataaagtcattcccagatgaacaaaaataaaaaaaattcattcctagagacctaaaaactggaaagaacatttgtccatcagtggccaaatagttatacaaaccatgctgtatctattcaatggaatgctatttggcaatataaaacaacacactattgatacacacgacaacttgaatgtatctcaatggcattatgctgagtgaaagaagctagtctcaaaagattatatagtgtatgcttccatttacatatttttcaaaaacacaaaactatagcaatgaggaagagatcagtggttgtcatagactagatgtggttggagaaggtgattatagagagttagcaaaaggaaagagggtttgaggaattaaaattgtcttatatcttgattacaatgatgattacatatgttaaaattcaaagacccatgtaccaaaaggcatctttactttataataattggaataaaataaaataaaaccaagaaaacccacatagttgaacactacactcacaatgaatgtattttttttttcttagagacagggtctcattctcacccagactggagtacagcagtgtgatcatagctcactgtagtcttaaattcctgagctcaagagatccttgcacctcagcttcctgagtagctaggactacagatgtgagccaccttgactggaggatgtatcttataatgtataaattatacttcagtaaagctgtaaataaataaaagttactgtgaaactgaatctaattcaggcaggacttctaatgctttagacccttcagaaatgaaagtttgttcatcctagcaaaggatcatgaataaatagttcaggtactcaaatatgtgtaatcagtatagaaaatttcacaaaaagaattgagttgatttaatagaatttacctcccaaaacacttccttgaaccaaattactggtatagttttcttaaaagtattcacaatcatacacattgtttaaacattctcagggtcagaatagctcggactaaactaagtagctcctgagtcaaaatgatatatcacataccagaatctctggaagacaactacagatgtgttaagaggaaagtttacagcagtgaacacctacaatgaaaagttaggaagatctaaaatcaacaacctgacatcacccctaaaggagcgaaaaaaaaacaagagcaaatcagctccaaagctagcaaaagaaaagcaaataaccaagataagctacactgaatgaaattgagatgtaaaattcatttgaaaaaaatcaatgaaaccaaaagttggttttctgaaaaaataaacaagattgatagattgctagctagattaataaagaaaaagagaagatccaaataaacacaatcagaaacgacaaaggtgatattaacatcaaccccacagaaatacaaaagctctgttatgaacacccctatgcacataaattagaaaacctaaaagaaaaatgtttgatatcactaatcattacagaaattcaaatcaaaaccacaatgaaataccatcttacactggtcagaatgattattaaaaattcagaaaatgacagatgttggtgatgttgtgaagaaaagggacaattatacacttctggtgggaatgtaaactagttcagccactgtggaaagtactctggatatttctcaaagaacttaaaacaaaactgccattcaacccagcaatctcgttactgtcattactgggtacatacccagaggaatataaatcattctaccaaaaagacacctgcactcatatgttcattgctgcactattcacaatagcaaagacatggaatcaatctgggtgatgaaatcatttgtctatatgcatgcgcgcgcgcgcacgcgcgcacacacacacacacacacacacacacacacacacacacacacgtttggatatattcccaatgaagaacaacaacaaaatggcgtatggtgtatcgtaactttccgtactctttgctaagactttttggacccagtagtggaaggaaataacagaagttaaactctctaccactttttttaagcaaaactatgtaatcgatttcactcccaccacacaccacacccccaccaacacacacacacacgttgttcccccacttcatcctccaccaggttccactggccacacaactcaagatctatggaatgcaaggaagaaaacagtcctggctagcttgaaaaaatttactgacacgctctcagaagaattcatgctaagaaaatccatatcccatcactaattttcagggtatggcaatggctttctcaagaatattacagggaacctttggagtatgacagcaaattgcttcaaagaggctttcttgcttttctccttcaaacatgtgtatctcatgtatgacccaggaagatatatatagattggttttctgggagttttttcctccatccacagatatggcagaaatatactaccattgatgggcaggcagacattccagcaacagatgaatattgaatacttcttataagtctactaagagctttacatacattatctcaattgacccttacaataagtttgagagatggctattattattttcatattatcctgggctttttgaggctcagaagtgtgaaataatttcccccaagtaatgcggttaccttaaaataccctatgaaaaatgtattattgctattttacaaataagagaaatgaagtgacttagcaaaatttacataaatagaaaggagttgaactggaatcaaaatgcaatttgatctgactacaaatttacacgcttatcatggtggaattcgcgtacaggctttggagacaaaaagacttagggttatatcccattctttccacttactagtaccatgaccttgagcacatttcttacttaacttctttgtgcattggtttcctcatctataaaatgagaataaaagtgataaagcatgtattgagttcagtacatactaactactccataaaaacagctggtgttatcattatcattacaatcttgtattattaacttcagctaaattaaattaattcatccaaggaattctgatgggactgtgacatagagatagttatctataaggaattgggaggggaggtcaactacctagaacaaagggaacctgggggagaaaccatagggggagtgcctgattggccaggaacactatgacagatttgagaaccctaaggtagaaacaagtgcaacaggcattggagtacaaactggaggggaattaataggcacttattaaaagtgctaggaaacatgatagctaccttaaattcttcatcttattttatctggaataagaggacccaatttttccttttaatatttccttagattataataaatcaccaaatcctattacttttgcctttgaaatttctctcagattcattgtcccgtatcattcctcttattccttctgtcatctccctgaatcaagtgcctatctttttatattcagatgcttaaaccggcacggtaatagcatgcactccattcttcacttcaatccacccatgttcctgtggcagcatggaaagcacaggatttagattaggacagggctattttgttctctttaggctttgaactgaaatataactttctgttcaaaatatgaacagaaatatgcctttctgaagtgtacaacttcgtggctttcagtatattaccattatccttatataattccagaacattttcatcacctcaaaaagaaaccccatattcattagcagttactgtctattcccccttcctccaggccctggcagcaataatctactttctatctctatgaatttgcctattctggaattttataaattgaatcatatactatatgcactggctttttccacttaggataatgttttcaagcttcatccatgttttagcatgtatcagcagcacacgctttttatggctgattaatactcccttatacagattctatatattgtttatccattcatcagttaatgagcacgagggttatctctatttttggctattatgaataatgctgctatgaacattcatatataagttttcatagaaacatatattttcagttgtcttgaatatatacctagaagtggaattgctgacaactgtgtttaacattttaagggaatagccagactattttccaaagtggctgcactattgtaaatttccaatttctatatgagaattccaatttctccatatcctaatcaaacttcttccttctggtgggtgtgacttggtgtctcattctattttgacttgcatttccctaatgattaatgttatcgatcatctttttgtgtgttttagccatttgttcatcttatttgaagaattacgtattcaaattctttgcccatttttttaaaattggattgtatttttattgttgacttgtaagagttcttatatatgctgaatacttgaccctttcaatatatatgttttgtatattttctaccactctttgggttgtcatttttactttcttaacagtaacctttgaagcacaatacggttgtgctatgtggttcaaatgcagtgtcttggtcattttgtctgtcttaggctctgggtagccagggttatagtgctgcaggcacccatgtgaatgtgatggaataacaatggggcctcagggatggaaaaaattagtgactactggcccccagggcagaatgcactttagcagtggatttagtttcaagatggcaccattctgtaacagcttaggtcatggggatgagaggagtgtttaacatgggctcctactataaggcaatgcagtcatgcaaactcctggctactttcctcccaactgcatttggagtctgtgaagactgcaagactctcatgttggagaactgctagtgtctgtggtagcagtggggaccgtgagagatgtacagcttacttttttctcgtaagaagtcctttccaactccaagccaatcttagtgggggaaagagtatggaaaagctgtacaaggattttgctgctcccttggtactttccagcacacttcagccactgcagtcaaaatatagttatatattcattgttttggtccctctttgtagggggagacaggcttcaaagaacagtatttacccatcttactgatgtcctaaaagctgtttttcagtttaaatgctgcaatatgaatataaagatacaaagggcccagaagtctcagagagtagaatttcatataaagcaaacaagaggaaaacattttccgcactcccctcacccccacccccgccaaagaaaaattcaagcagaatagaaagagtatgggaggattgtggcatgaagttaaatgctggtacatccctcataggggcttataatcctgtccatcctcctggctaagcccctagtagggagaataatgagacaaactcataccgattgggatgggggagtagcacaaagcagatgaattttcatttattaattcagtttatttccttcatttattcattcatatattcatttaaccaacaaataattattgagcacttactatgtgccatgttctgtgtaagcattgggatgcagctaggtctcacttccatcataaagttggaaagtacaaaaagtctggtagagaactgttctatgtcagcctggctctgcaatagtagacataacagaagctaaatctaaaaagagaaggccagagatattccctacctgctattctcaagctctgaagcccaggaagaacaagggacagcatctaaaaattccctatgttcctgagaaaaaggtacgatagtggctgagggtgggagatggcccctggaggaacatcataattaggatgaattgagaggctattgtaatcagtacgaatctagttagcggaggcaaaggggaagaggacattttagtgcactgcagtaagagtcagttccagtgaccaaagatgttaatggtgactatatttttcaacagaaggcagcatgcatggatgcaataaatcatggacacattaacctccccactgaagccagagtaacaaggccctacccctgtggaatttagatcaaaggtctgaggagaagaaaataagtgaaaaggagggaccctgaagtcaccaagtagaaacctagaattgggcaaacttaaatcataaagtgaattattttctctgaaagtgacagtgttttttttttttttttttgagacggagtctcgctctgtggcccaggcgggagtgcagtggcgcaatctcggctcactgcaagctccgcctccagggttcacgtcattctcctgcctcagcctcccgagtagctgggactacaggcgcccaccatcacgcccagctaatttttttttgtatttttagtagagacggggtttcaccgtgttagccaggatggtctcgatcttctgacctcgtgatccgcccgcctcggcctcccaaagtgctgggattacaagcctgagccaccgcgcccggccgacagtgttttaaataatctgctatcactggaaatagggacttaactaaatatttttaaaatagaaacaattttgaaaagtaaaatttcatatactttggttttatggcaaaaagatgtatactcactataaagtatcattcattattttagataaaatattaactttttgtggtagaactttctttaaatatttatttttcttttggaatgagaattttcacactaagtagctccacaaacactagcaaattccacccagcgttgcctccttttatacttagggaaacaaagcacttttgaccataaagttgttgctcaaggttgtaaaatcagtgacaaatccaagttccttgacttccactccagtggcattttcattatcttcaaaatttctttaacaccaaatgaaaactaccacgcacacatactttggagactcaatttccaattggatgtgaatagtttaagtacgtttacaaaagtaaaattttaagaacaaactgttcaattttcctttatttaaattctctatagagattactaatgataaataacatgcaaagtatgcaatcctaactgagaaaataggtgagccaggcagtggtgtcctggtcagtgtttcacagctggttcctagtggttgaggggcctaattagtggaggctgctgatttccatagtgtaaatagtcccactataaccaatttcaagttatcaacatgatgtcaaaaaagtgggaagtttaaaattatttgaaaattttaaaatcaattttgcaagcttattacaagttggccttagcacactgctgggaccagggttgtttctccagagcaaagactgacttaagcatttacttattagaattcaggacattttatcaggacaatacactgaagtgctttaagaacatatatccacttagtatggataattatcatgaaattggtgtacttttaactacatgtggaaagtagctttttcttgtaatttcccccagccaaatataaaggaaagtgttaagtcttcacgcacatgcagttctctgaatggaatatttaagagaatagaaattaagtgtaaacacccttttgtgagattcacataaaaagaatcaaccatatctgtttaattttggcaccttatattcctctcatatgacacaacagaatagctacatttatacaaagtctaaatttttctcctttctacattataaagataaaagaaaactgagggcagttttaaaatggcttgtgaaatgtggtttaggcaaaggagtataggcacaagattgctaggcctctatacaatcagagagctatataatttggcagacctttctacgatgtaatattgaactttgccctttatagttgacatattactaaaatgatatgtctgtgttacattgtgaaaagtcaactcacgttttagaaccagagttctgtttttttcttgatcctagatatctttggaaatctaatgaaaactaatgagtctaatgaaacacttttaaagaacaatgcacatatttatagatacagaaaactttgcataaaatgttaaaggactcacagacattctgtcacttgaccatgggcttctagactcacaccaagaaccattttaaagtgtattaagaaatcttgacattcaaaggaaacccatgatgattattttagaaaagctatacaattatctgtaaaggaaagcaatcaccttaatttatattttccttaaattaagctttttaaacttattgagtttacttatgttaagtctagatttctagacataaatttctgaaagacatagtcacagatatgaggagtaaagggatctttagagataaaataccataccacaagtcctttattttataaacaaagagaggacctaagcactgaaccaactagaacaaaatctccatgaccgaggaggcctcataccattgtataaaggatacatccctggacaatttcagaaatttcagaaaccctgaattctagtaaagtcctgccatttattattcgcatggtattgggtcatcatttagcttctctaatgtttcctcagctaaaatcttagttatactacaaagttgttacaaggattaaatgaggtatttgtgaaaacagtaaatattctaatgccatgtaacaagttaatgaaattataattatgataaataacagacgaacgacatgcattcttcctgtcgggaccaaacttattagacgcaggtctagccaacacctaagacagtcttttataaagaaaaaaaaaagtggctcaaaggtactgagattagtggtcacaggaaagacttctggtataagtgggataatggaaaaagcactagattcggaattaagagatttcgttgtagttccaattctactactaactagtaaaactgaaaaattatttcagacctctggccctccatttttgtggagagcagattttcttaaacatttgaagaagtgccacagccagacccctttaagaacacactgaaaattatgaaaattctccccacaaaaagtatacatttggcacatcattgaaggatctcaagttagctattaaatttccacaagtggcatactaacaacccagacattacttataaattgtttctagaactaaatcaatttatatatatgaaatattctataaatgtacacattatagaattatagaattttgagaagtaaaattgaaggcaagtttacagatattttatgtgaaaaatgtttatatttagtaacagttattacaatattggtttctatatctacaacaaaaaggtatcattttactaccataattaaaaattatctactaaccctttgctacttttatgataaaatcaaaactcattattttggcatttctaatttgagttcaaccagctttttgcctcatttataactattcttctcttacaaccaccccatctttctcttacctcaagtcacttgccacacttaaattctcatcagttgatggatccagtggaacttttcatgctagattcactggggctccgtgcttttgtacctgataatctctctgccaaaagttcctctgttatcctaattcacccagttatcttcaagtttcaggtctaatgtcaaccttccccacacatactttggagaactagttggcagtactataaagttaaatatatgcctattttaggacccccaaattccactcctagacatttacccaaatgaagttaaagcctacatccacaaaaagatttgtacaaaaatgttcagagcaactttattcataatagccaaaatcagtgaataactcttcaatagatcaagttgtgatatatttatataatgtaatactactcagcaataaaaaggaatgtaaccactaatgcatacaaaaacatggatgaacctcaaaatcattatattgagcaagataagactgacaccaatgcacacatattttatgtttctatttacaagaagttctagaagagacacagctaatccccagggacaaaaatttaaaaaagtctaaggaataatgtgtgaagtgattctaaagatgcatcagagaacttcccagggtgatagaagtttatggtgaagtttacataattatatgcgagaatcaaagttcattgaaccaagcacttaaggtctatgcgtgttattggatataaattataactcagctattgcttggcttgatattctaaatattaattctgaaattcttcctctattataatagatctatattttaccaaccactcaaggtgattcttatgaagatggctagttgacctctctttggaaagtaccattgatgagagtttaaaacttgcccttttactaaaattatactttccacaaaataataaacaatatatagagttctaaccatgactttagacagttgtataaatacacacagtgagccacaaatagattaagccactgttcacatagtctagactctagatcccaaacctggatacacttcagaatcatatagaaaacaaaatatagaactttgggttctacccccacaccaagaacgcagaatatttttgtagtgagacccaggaattactttttttttttttttaagttttccctggagacagtgacatcaacaagatggcagaataagaacaaacatgctcatttcccccacaacaacaacaagaattctgtactcacccacatccaaaagtctctctgcagaagtcttgtgaattcagataggaggttgtaaacccccccatggagcccaacacctaggggggtcatttcgagagtgcacaccagcacccaggtatctgattcaacaattgtgctccagggttcaagcctagaaacagcccacttgccaaagagcttagctatagccctctttgtcttttagcctgctaccaaaaccatctgacacggggttgagatggaatcatcttagcaaagaggcttgtctgcctgtttaaatcagtcttgacagtgaatctaagagttatccagtggctcagctccagccttctcagttgaagtcccagctcagtgctgttcacggaagaatccagaaagagatttgttcatatctcacagcccaggcatctgagcctgcatgagactatcactaacctccatcctacagcggttcccaaggcggcccagtctcagcatcagccccttgcattgcagttggagaactaccccatctatgcagggacttgctgggagatgaatatttctctgagccaataaggctgggttctgcagcctctgtcccacagcagatatggaggtggtccagtctcagcttaggcccctcctgctgcagtcaggaaactatctttgcagagacctcctggagatacacatgctcattagagccaatgagaagggttctccagcttccttcccacagcagatcccaagggacctccctctcagctccagccccagtctgctgcagttgggaaactatcctgtttgtgcatatacttgctaggaatcacagacctgtctgagctaatgaatctgagctttccagcctccatcctgcagcagatcacaaggggccccatcagctccagctccttctgctgcagttgggaaactaacctgctgggagactcatgctcctcatggctaatgagaataagctctccagcctccagcccatagcagatcccagtgtagcccagtctcagctccagcccctcccactgcagttgaggaactatctaatctgtgcagggacttgcagggagacatgctcccctcttagccaacaagaccagcccctccagcctttgtcccatagcagatccaaagagagccagtctcagatcaggccccacccactacagtagggtagctacgctatctgtgcagagatctgctgaaagacccacacacctctgagccaatgaaacagtctcaccaatctcctttctacagcatctctggagagggctgagtctcaacttcagccactcttgctacagttgaagacccatgctgcctgtgctggagcctacatgtagaccaccaagacagtcttctatacctaggtccctggccagctttcccacacagccctggtatctgacttaggtgttccccaggtctgtctggcccagaaagctgtgaatctcaaagcccacgcaagacacatggcttgggtgccctttagtactggggtagctgtagtggtcacagtctcatgggacacaatagtcagtcttcttagagtctctggaaggtcctctaaagaagtacaggcacaaaaaagactgcaaagtaaaataaatacctatttcctcaatttgcagaaattgttacatccacaagcatcaagaacattcagggaaatattacctcaccaaatggacaaagtaaggcactagagaccaaccctaaagtgatggagatgtgtgatctctcagacaaagaattcaaaacaactacttcaaggaagctcaatgaacttcaaagaatacagaggatgaattctgaaatttgtcagagaaatgtaacagataaatcaaaataataaaaaaaattctagagcttaaaaatacaatgaatgaaatgaaaaatgtaatagaatcaacaacagaaataaaacagaagaataaatgagcttaaagacaaactatttaaaacacagaggaaaaatgaaaaaaatgaaataaagaaagcttatggactctatggaacaatgttaaagcaaatatttgtgttattggcattaaagagggaatggagaaaagcaatgtgataaaaagcttattaaaaaaaaaaacccaaaactttgcaaacctggaaaaaaatataaatattcaggtacagaaaggtgaaaggtgaacaagcatattcaacccaaataagaataacttaagacatattctaatcaaattgcaaaggttaaagacaaagaggattctcaaagctgtgagacaataaaatcaaataacatacaaggcagattcaaatatataaaatagccaagtatataaagcactggagcatccaaatatataaagtaaatactaatagatctaagggaaaaataaactgcgatataatagcattagggactttagcaccctattttcagcaatggacagatcatccagatagaaaaatcaacaaggaaacatcaaatttaaaatgccctctagaccacatagacctaacaggcatttatagaacatttcattcaactgctacagaataaatattctttcctccagcacatggaacattctccacaatagatcatatgttaagccacgaaacaagtctcaacaaattttaaaaggtcaaaataatattaagtctcttttctgaccacgatgtaacaaaagtgaaaatcagcaaaaagaagaaatttagaaactttacagatacatggaaattaaacaacatgctcatgaacaaccaatgagtcaatgaaaaaatcaaaatgaaaattttaaaaattctcaaaacaaatgaaactgggagcactttcataccaaaagctatgggatatagtgaaagcagtactctaagggaaatatataacaataaatatctacataaaaaatctaaaaacttcaaataacctatcaatgcacctcacagagctagaaaataagaacaaacccaacttatattattaaataaacttaatattaataataaatttattatttaataataaatatcagttctaaataaatatcccataggttttggtgtggtgttttctactttcattttccattacttttaatggcaaaaaaagcattacttttgcaccaaactaatacaacacaaaaataaacatcagaccatatataaatgaaattgatactaaaaaaatacaaaagatcaatgagatgaaaatctggttttttaaagacaaacaaaattaacaaacctgtagctagattaagacaaaaaaagagaagagccatataaacaaaatgagagaagagccatataaacaaaattagagatgaaaaaggagacattacaactgataccacagaaatacaaaggatcattagagacaactatatgccaacacattaggaaacctagaagaaattagtgaataaatttctggacatatacaacttaccacaagtgaatcaggaagaaatagaaaacatgaacaaataagtataatgagatcaaagaagtaataaaaagtctcctatcaaaaaaatgcctaggacctgatggcttcactgctgacctctaccaaacatttaaagaagaactaacaccacttctactcaaactattcaaaaacattgaaaagaaaatacttccaaactcattgtatgaggccagcattaccctagtaacagaactagacaaggacacagcacctaagaaagctacaggctaatatgcctgataaacatagatgcaaaaattctcaataaaatactagcaaactggataccacacattaaaaacatcatttaccataatcaagtgggatttagtccagggatgcacagatggttcaacctacaaaaatcaatcaacataatacatcacattaacagaatcaaggacaaaaacaatactatcatttcaattgatgctggaaaaacatttggtaaaattcaacatctctttatgataagaacttttaaccaactgggtatagaaggagcatacttttaaaatgataaagtccgtatatgacaaaccgacagctaacaacatactgaatggggaaaaattgaaagcatttccataagataccgaacaagatgaagatgctcactttcaccactttcattcaatatagtagtagacgtcctaaccagagcaattagacaaggaaaagaaataaagagcatccaaaatggaaaggaagaggtcaaattttatccttgtttgcagaagacatgatcttcttgttagaaaaacctaaacactttagcagaaaactgttagaactaataaatttggtaaagttgcaggatatagcatcaacatacaaaaatcagtagcatttctatatgttaactgcaatcaatctgaaaaagaaaccaagaaggcaatcccattaacaatagttaccaaataattaaaatacctagaaataaatttaaccaaagaagtgaaagatctcttcaatgacaattataaaactctgatgaaaataaattgaagagaacacacaaacaaatagaaagatatcccatgctaatgaattggaagaattactattaaaatatccatactccccaaagcaatctacgaattcaatgcaatcctttttaaaacatcaatgacattcttcacataaacagaaaaaaaaaactcctaaaatttgtatggacacaaagatcttgaaaagccaaagcaatcctgggcaaaaagtaaagctggaagcatcacattgcctgacttcaaactgtactacaaagctacagtaaccaaaacatcatggtactggcataaaaacagacacacaggccaatgaaacagaatagagaatccagaaataaatccacacatttacagtcaactcattttcaacaaaggtgtcaagaaaatgcattggagaagggacagactattcaagaaatggtgctgagaaaagtggatatccacacgcagaaaaataaaaatagatccctacctctcactttacaccaaaagtcaactcaaaatggagtaaagtcttaaatgtaaaacataaaactataaaactaacaaactaaatgtccatcagtgaattaatggataaagaaatatatataattcatatatatgtgtgtgtatatatatatatatatagatatatatatatataacaatggaatattattcagccataaaaagaaataaaattctgtcatttgcagcaacatggatagaaatggaggtcagtgtgctaagtgaaataaaccaggtacaaaaagacaaataacatatgttctcaaccatatttgggagctaaaaaaaagtggatctcatggaggtagaaaatataatggggttaccagagactgagaaggctataagggaaaggaggttgaagagaagctggtaaataggtacaaaaacacagttcaatagaagaaaaaagttacagtgttcaatagtatagtggaataactatggttaacactcattcattgtgtatgtatgtcagaatagctgtaaaagaattggaatgttgccaacacaaaaaacagataaatgtttggggtgatggatagccctgttacctggatttgatcattacacattgtatacatgtatcaaaatagcgcatgtatccccaaaatatgtacaactattatgtatcaattttgaaaaatctaaaacataaaagttccctatgggattcaaatgagcagcccaattaggaaagactgacccagacagtaagtattagcaaagaaagagatcagagtgtgatgtggttatctattcaactatatcttctccttgtatcaaaaagatttctaagacttactcaagatccaatctttttgttctacattttttcaaatgtaacacagaatacttgcattcctttacataatcaatagacacaatgttttatatagcattatatggtttggatctatgtcacccccaccctcaaatctcatgtggaattgtaatccccagtgttggaggtggggacgggtgggaggtgatttgatcatggggggcagatttcccctactgtactatcctcaagataatgagttctcatgagatctggttttttaaaagtgtgtggcacctccctgatctctatcttcctcctgctgtggctatgtgaagtgctggctcccccttcgccttctgccatgattggaagctccctgaggctttcccagaaccaggtgccagcatcatgcttcctgtacagcatgtggaaccatgagtccattaaacctattttctttataaattactcagtctcaggtatttctttatagaaatgcaagaacagactaatacatagtagaaagacctaagaatttgaagccagatagacctgggttggaattctagctctgccccttcaaagcatgtgacgttgaggaagtcatttatccacttgaagtctcaaactcctttttggcaaaaaattgagttattgatatttctttgatataatgaatatgaaagcaccaaatacatggtatataagtaataaaggtttgctttattttatcccaataaatgtgaacagatatttctacacttcagtaaaacaaaataaaatgggaaatctcctgaatttgtaatgaagtcgattctactctattccttcttactggttagaaagtgctaatcttctgggcgtggtggtaggcacctgtaatcccatctacttgggaggctgaggaaggggaattgcttgaacccgggaggcagagcttgcagtgagacgagatcatgccactgcactccagcctgggtgacaagagcaaaattccttctaaaaatgaaaaaaagcgcatatctttttttttaatttcaagtccaatgtcatcacatgtattttttgtcacaaaaaaaatcttcaaagattcatttatgtaacttcaatttcctctgggcagttgtttttcatagctacacttaccatagttctaatggtataattcattatctcatcatcgactggacatttcatcaaacacatttcactgttgagacaacttgtcagtgatattcaatttgctgtctcatcagcaatatagtatatagtaattaaatttttatcatggcatctcatccctattgctcatccataattcatatttttctgtcaaacatcaaccctacatatattgtactaatgaggagggaaaacagagtttaccttctcagatgtcttcttagactgtgtaaacaattgcattctttttctaagaggagggctagccaaaggcacaattgtgaagcaaaagccctactcccccagcctaccttccaggtatttgccaacctacacatatcatctacaacaaattctctctaaagtactaatgattatttaaaacaattataaatccaatttatctttcaagctgtaatgcaaaaactactccttctatattttttattcttcatcagtagcatttgagctaccaacttctggactgaccttcccattattttgtgaggttaccagtgggtaagttcaagtccttttttaatgcaattctcagtgcttaacacaatgcttggcacatagacccattacatgtgtcaaattttatttaaatgagtcaattttatattctgagagaatatttacattttgaaagaaatatgaaaagaatgaaagcttatatatccaaaaattcatattttggcacttagatgaaggagatatttatatatggggtgggaatggaactttcttatcactactcaaattatatcacattgtgtgcagactgtttcacccactcatctatctctccagcctcctttttacccctagactctaacataactattccttctgcttgattgccctttcatgccctctacatctggtaaactgctttttatccttcaaaacccatttcaaaagtaacctcctccaagaagcccttccaggcattctccacctcttctgagtttccagaagtggcatactgtgtttatgcctctagtaatagtacatagctaccagcaatggggtacttactgtggacagacattatattagatattttatagaacttacccagttttattcttgttagaaccatatgaaatagatgttcatttcattcttgaaaaacatattcaaagtagttaagtaacctactgaagatcacacaggtggtaatcaacaaagcaggaatggaagctagactctgactccaaagcccagaatattttccatgtatcatacagtttcaaaattaatgacaaaatgactgaatgaatgatgactgtgacaaaggatagcatgtcctcatgagcacacatatggctaagataaatttcaaatttcactctctcttccacattttatatttgatatgctagcgtatactaagatacctttgttaagatagctaaggcatgcagaaaaaaaaaacaatttcaatttcaatatgatactcttagaatcatgacaaagaccttctattgtaactaagcattttagaacacagttttgcaactcaaaacctcagtgtcaagccagtcttattatgtgttctttccatttaagcccattctgatcacattttccctggatcagccccagtggtcccaacagggagctataacatgcacaaaatgtctgctgagccaggttaaatgaatttcagttaagggactaatattattaacattatatgatgatttgcaattatcagtcaaataagatcagctaccagagaaccagggagtccttagtaagaggtgaaccacaaaatcagcacactccctcctcaatgagtttataatctaaatgggcaattgcaaacaagggagggatagaagggctctccggggagaggtgagaaggagtccttcatttgttcttgtcctcaatgaaaaaggcttatgtaagaaaacaagttcaaccgtactcccctatctaccctcccgcaatatgtaagtcctttgcaagtacactgggttcatgcactgataattgagaggtggctgtggttcagcaaaaagcattgatctggactttagaacccaaggattctagtcctaaatctgccactaactagctctatgaccttgctccctaactattcatcttctacagtccctgtttctcatcaataaaaataaagatcacactagttcaatctgagagcctccaactctaaaatgcagtaccttagcactgaatacaaatacttagttaagttcaatttctcccactctgtttccaagctaatatcaatgttgattttttttagatttttagcaacctgccccagtatagattcttcttgtactagggctggtacaagaaggcatcaaagaccatggagcagaattgtttacacaattctgatttaatgcctccagctcttctctgaacttatgggcacaaagaaatcagtcttttttttttttttttttttttgagacagagactttctccctgccctgtccccaggcctgcaacctctgcctcccaggttcaagcaattctcctgccttagcctcctgagtagctggaattacaggagcacactaccacacccagctaacttttttttttttttttgtatgttcagtagaaacagggtttcaccatgttggctaggctgatcttgaactcctgacctcaagtaatccacccgcctcggcctcccaaagttctgggattataggcatgagccaccataaccagcctagaaagcagtctcttcaccgaaattcatttatataatccaaaaatttctttataatctgaccttccaatactcctctgatttcatctcctatttccaatcatggactcctcttcagctgcctccttgctggtcctctgtcacaccaagcagactcctgccctcagaggctttgtaccttttattctccctacctagaatatctccctttttcataactgcctagtttgagctctcactttcttcaggttttcattaataagtcactttttcaataacacctgccctcatcatcctttctgcccactcaccatttcatatcctccatccctactttattctgtcctgaactttgatcataatctaattaattatttatcttgttgatcatctgtcttccccattagaatgtaaacccagtaaagacatatttttttgggtcagtttaattcccttcaatattccaagtacctagagtagtgcttaggatataggaggcaggtaataaatatttgttgaacagatgaataagccctcatgtctcaccactctccccctaattcactgtgctccagacacacttgtcttctccttcccttatcatgcacaccaaacatcctctccctcagagcctttgtattgtacttccttctgcctcggatctcctttcaaagatatccatatggggttttttcccacattttattcagacctatatccaaatgttgtcatgtccaagaagccttctcaggtcaaattatctaaaatggcagtctcatttttcatacacttttcttatactttttttttcctttataaccgtggcagtggtggaactaagccactcagatctctttcaaaagaactttcttggggagcaaattgactgacagtcccaactgtctgtattcacctctgcatgctctgaggccaagccttccccaagatggtcccagccagtatttcagcacagcaggaataatactttaagactattcctaatgactcgggactcctctaataggcaacttgggctcaggaactacccatcaacttagctgaaacttctttaaaactgctacaatctgagattcttcttccctaaaccttcttccttctcccttccatttcacaggcttcagacctgcataatagcctgaaggctctcctgtctaatcttattccctccccttcatctttcacaggtatctccccctttaaatctcattcttataccatctaattctgtcttggtgtttgcttcttggagtacctgaaataatacaataaaacttatagcatattcaatattaatttgtttatttgtagttgctcatctctacctcatgaaggttgagacttggtctgttttattaactactagatctacagcatgtagaatgatgcttgcaaagaccaaatatctttggtagacaaatattactgctacatattatttcatttatttgtgaaagaaaataatgagtgtctagtatgttttaggcactatgttaagtactcagtagatcaagggtctagtggaagagataaatatataaacgagtaattataactcactatctcaaggatttattaaaagtattcacaatgtatggagcacaaataacttcataaacagttaataatttaaatcctatacatgtttaaggtattgttaatatcccatgaactatagaaagggtaattcaaccccaacaactaagttcccttgtctcagccaagacctcctcagaagtaaggtgtcccttgtgaaaattttcttcaggtatataaagtgaagtgaaggctatcccttgctgtataagagtaccctgctcaagattacactgattggctaggtaaaaaaggtaaataagtttgtggttctatgccctaggaaaacaatctgtgaaccagataaattattggaacttttctagctcaagcttcaaaaaatggtcccatgcaaatatcacctattctatgaacatttatgataccctcactactcgtcgaggtcactccttttatatgttgaagcactctgtgcttctccttcctagcagttaccaaaagtgtaatttattagtcatttgggagctatctcattagtagataataagctccatgagaaaactacatctattatattaactgctatatctccattgcctggcaaggaaaaaggtctctatatttcttgaatggctgtataaaataatgactgattaattaaatgaaaagtttctgcttatctacctaattgtaaaaattatctccctcatcaaaattcccattgcattttatctattatcttacactccccctctatccatcatatatccatatatcccaccttatatccatatatcccctatatccattcatgatgtagatataaactttacaaataaagaagagtagtacacctcgaccccactagtcacagaaaaattgtcagtctttggattcagttgctcttgagatcattcatccttcccagatgttgacaccccgaatcgagatttgaaggtgacaagtaatagtcctctgatttccactcactccctctcctctcccctttctttctccgtctttctctctctctctgtcttcctctctctttataagaagctatgaaggcagaagcatagtaaaaaatgaatgggtttgagttagaaattctacttggtctgagttccatttctgtcttttccatcacaactgatttgctgatcattgaggactgactgtgctgacttacaggaaaacaaccattaatattaggaaaagcctagagagatgaggaccaacaaaatctctagttgagtaatgtaatctaacctgaaaatctgtagcaatcaggcctacaagagtaacaaaaactaatgctcagcatttctgcatctgctatcaaaaaatatcaaagcactctcacatctactatctccttattttccctcactataatctttaagtgctaggcaactaaggcattgagaagttaaatgacctgcccaaggtcacacagcaaactgatgactcatatctcaatgttctttctattaagcaacagggaggtaagttgaacatctgatcaaataaaagacctttctcatcctattacctcaactgtctctctatgtctttaaggcatgaaattaagaagtaaccagataaaagtaagatgaaaactgctactgcctttgctacaaaatgtgagtaggtaggctttgctgtaattatggagaatacatatctgatttaactcccttatttctttactgtctggatatttggtaatatttgataggaccacaaaggcataaaatgaagaaagagggaaagaaaaaaaaccatatagataaatgtagaaacattagaatttgccataatgattccaaagggtctctcagagttaaggtagatgctgttgatgaaaagagtaaaattctctaaaatatttgaagagatttattctgagccaaatatgagtgatcaatggccgctgacatagccctcaggagatacagagaacatgtgcccaaagtggtcaggctacaacttggttttatacattttagggagacataaggcatcaattaatacatgtaagatgtacattggtttagtccagaaaggcaggacaactggaagctgagtgggggtgggggtggaacacttccagttcataggtggattcaaagattttctcactggcacttagctaaaagagttattatctaaagacctggaatcagtagagaggaatgtctggggtatgagaagcagttgtgaaaaccaaggttttattatccagatgaagcctacaggtagcaggcttcaaaaagaataaattgtaaatgtttcttatcagacttagtctattttatcagcctaagttctctgttgatgttaatgctggtcagctgtgaggcatgtctgacccatccccctgcagttctgaactaccagttgatttctaggagattctactatgctgtcttaattagaacctttctatgtctcaactttggaatgcccttggtggacaggaagggtatgttcaggtggctgggggacttagaattgtattggtttacaatgcactaagaggactttagggtcctgccttaagaggaaccttagacagaaggtgatagtacaatggaaaaacagggaagaaagtgggagcaggtcacattgccacaggcctcagttcatatttctaacccaaaccccaaagtaaagaagataagctctgcatcttacctgctccttttgaatctcctccttctcattatagtaggttagttccagggctccgctaaacttcagggtagaacaagaaaattacctcagcccatgctgttcactcctaccatgtcccgttgtgagccccataaaagctgaatatggagatttctcatcttcccagtctctacggtctaccctctcctttcagctgctacttttttctctatagctcaactcctttttagctctcgtcttgattattaggacaaccttctggttctttttacttcctccagtgtcagccactcaagtcattgcttgacactatttcaaaactcacattcctgaagtagatagctgatctctacaacacctcgcaaaaatctttgaaaatttctcaactaaataaagaatacagttgaaattcctcaacttcatatgcaattcttacccatctctccctacacgtccctgcccactaccaatatatactccactgtggccaattaaattcacaaacctgacttgcatttactcatctgacactactctcacacttttcccagagcctaggatatcctcccacaagtatctacatctctttttgcagtatatgtttcccctctcatctgaatttcatcttgattttaaaatatcctaagctggtctccaagactacttagcttcaggtgataaggcttagctcaacactttggatatccacataaaactactttaaacttttgttaaatttatcttcttaaattaggaaacttgatttttttatatacatacaagaccaataaatactctgtaataaatattcagtttctaagagaccagtaactaagacttttccatttatttgcctgggtgctctgaatgataaatcttttatcaaaaatagagagatttgtgggtaagacaaattgctccataatactttcacaatgaaaacttatccaagtcagatctggccccaaatatcaattccctgtgcatttgtattctgacgaacctatcacagtgacctattttcataccagtgactaagttaagaacgtgattgcttttgaaagaaactgaaataaaaattccaagaatggtattaggagaaatgaataaatcaaacatgattttctacaaacacaagttcataatttaagcctgctaaaacatgtgtgtattttcagaatgagaggaggtgtttgatgttataagtccattgtgactgaataaaaaattacagaccagttcagttttttaatggcattatgggtgcttactaattttttgctaatggttactgataaaacaaaatttaaaacataaacgtttgctgaatcctgtgaaaatctctttttctcaaatactttcatttaatttatttaacaattatatatgaagaacacattctgtgtgctgaaggaattcagaatatgccacctcaaaatattccactttgacctaaggattattttgagctgaaagcaattgagaaaaagtagacaaagagcaaactctctgccctcaccttttctacaaggaagggcaagatgatttttaattataggagacgattctagactcttaacccaaagatgttccagaagaatctacataacaaaatcttactaaaacaacccttatcttccattagtttcctcatatatttacagtttgctacccctaaaagcctatttttctttgtcttgtcccttctctacaaatttactcttctttgttaaaatgctacataaacccaagttcctaccacccctttgaattacacaatgcatgcattaataaacttgtttgtttttctcttgtaatatgtcttttgtcaatttaatttacagggaatgaacctaaggaagtagagagaaaaaggtttcttatccctcatttacagtttcaagaacttaaaatatacacaatgcttgtcttcaaggatcctaaattctagtgaagaaggacaattaaacagatcattaggatataaaaataatttggaagttaaaaaaaaaaaaaggaagcacagactggcacaatgatgtgcatttgtagtcccagctactccagaggctgaggagagaggatccctgaatgcaggagttcagatccaccctgggcaatacagtagaaacctcatctcaaaaaataatagtaatggtaaggaaagaaagttttttaaaaggcaggcaattaaattagatttaaaacgacaagaaagtcagtgggctaacacaggatcatacaaatagccagtcttgacccctccagactttacgttcctacttatttatagcaaaagcagaaaataggccatttttttcatggaaataagtaaagtacctaaaaaaattcaacaggattaaaatccaataataagactacagaaatatttaatgtcattaatttatcttttgtgtttgttgttcatttattcatatctttgacaaaagcttttgacaagcatttttgcaccaggtttgtatgcagttatgggagattcctaggaaagttatacaggttccatactgcaagttatttaaagtcctgtagaacttcatcagttttcatgacattagcatgtttgaaaaatgggaacaatttgatttaggtaggtacctgaatataaatgtgaatcacagaatcttagggtcggtcacctagttgagaagcacccttatggttaaaataccttttttttttcttggagacagagtctcactctgtcacccaggctggagtgcagtggctgaatcttggctcacggcaacctccacctcccgggttcaagcaattctctgcctcagcctcccgaatagctgggattacaggcacctgccaccacgcccagctaatttttgtgtttttattagagacggggtttcactatcttggccaggctggtcttgaactcctgacctcatgatctacccacctaggcctcccaaagtgctgtgattacaggtgtgagccgccgcgcctggcctacaatatctcttataataattcacatttgtatagtacttcataagagttgaaaactcataagacttttaaatattttatttcattttatccccaaaacaatattgtgatattggtaaaacaaatattaactcacaaagagggagagtaagactccaaaagataaaattataatttttttaaaaaaaggaacagaactatgatatgaactcaaactcaagattttaatccaatatgtgttctattaccactcaatcctttaaaggtcacacttttaaaatggatataccgcagatcccaccatcacctagattctctctctctctcacacacacacacacacacacacacacagagtttcaatcatgcacacagagtcaattatacacaattgctaaaacatgaaattctgaattgcaagtctttgcaatgactcccaccttaaaatacaatacatcattttataaggaagcctccctccttttctatccttgtccaaaaccaatcaattaaacaccagagtcaagataactttggaaattccaggcaattctgaactaccagttgatttctaggagattctactatgctgtcttagttagagcctttctatgtctcacctgaattatcccagcttattcctatgcaacatactccagttgaaaccactcaatcacaagtacagctgaactcaattcaagcattttctaaattacaccacagtctctcctgattccgtccctttgcacatgctttcctctgcctgcaatgctattcccttccctatgtatctggtttatttaaaagttacctcttcggttgcttttgtggactttgtcaaaaattcttaccaaggccaatgtcaggaagagtatttcctagattgtcttctaggatttttaaagtcttacttttttttgaaggcttacatttgaatattttattccctttggattaatgtctgtacattgtgaaaggcgggggtcaagcttcagttttcagcatatggctagccagttatccaagcaccatttattgaatagggattcctttctccattgcttgtttttgtccaccttgtcaaagatcatacaattgtaggcatatggctttatttctgagttttctatcctgttccattgctctacgtgtctgtttttgtaccagtaccaaggaattgcaacaaaaacaaaaatagttaagtaggaccttattaaactaaaaaggttctgcacagcaaaataaactgtcaacagagtaaacagcctacagaatggaagaaaatattcacaaactatgcattaaacaaatccagaatttgtcctatgcaagaacaaatatctagaatctgtagggaacttaaataaatcaacaaacagaaagcaaataactccattagacaatgagcaaaggatatcaacagacacttctgaaaagaagatatacaagaagccaaaaaacatctgaaaaaatgctcattatcaccaatcatcagagagatacaaatcaaaaccacaatgagatatgatctcacaccagtcagaatggctattattaaaaagtcaaaaaacaacagatgatgatgaggctgtggagaaaagggaacacttatacactattgttgagaatgtaaattagtccaaccattgtgggaaattgtctgaagatttctcaaagaacttaaaacagagctaccatttggcctagtaatcccattactaggtatatacctaaaagaaaataagtcattctaccaaaaagacacatgaactcatatgttcctggatgcactatttacaatagcaaaaatacgaaatcaacccaggtgcccatccatgggagattagataaagaaaatgtagtatatatataccatggaatactatgcagccataaaaagaatgaaatcatgtcctttgcagcaacgtggatgcatttggaggccatagtcctaagcaaattaacacaacaaaaccaaatagcagaaaaccaaataccacatgttcttacttatagggggaagctaaacactgagcacacattaacataaatatgagaacaatagatgcttaagactactagagagggaggcaaggagcaggcatgggttgaaaaactacctatcaggtaccatgctcattacctgggtgatggaatctgtaccccaaacctcagcatcacacaatatccacatgtaacaaacctgcacatgtaccccctgtatctaaaataaaagttgaaattttaagaaataaaagttacctcttcataaaagctttttctgacacctctggtctctaggctagattatatactccacttctgtgttctctgagtttaattctcttataacactttcattacaatatttttccatatattagtacttctttagtctctgtcactagggtataaactccttgaagacagagagaactaggtcatttatcacaactccagtgcctaacatactgcatgatggtcaaaatagaatcccaaaatcaggacatcagcatggccgtgttctccctgagggttctagaggaggatattttcttgcatttcctagcttctggtggttgctaacaatcctgatgttcctttccttggagatgcatcactctaatctctgacactgttatcaggtggcattctccctgtgtatctatatctaaattcccatctccttataaatagtagccattaagttagggcccactctaatctagtatgacctcacttaactagattatatctgcaaagaccttacttccaaataaggtcacattcacagatttttgggtggtcatgcacttcagggaaatgcgatttcacctagtacactgtgtttcaactggagagaggagaatctgaaattctgcatttggagaacagtactcaagcaaccaacccagctatatttgatttgacatcccaggtcactgccttatttatgaaaccgaaacttcccacaagaaattacaactgctttttgtcttaatttggagagtttattcattcattcattcctccactcatccatcacatatttatgaagtacctttaacatactagtggtatggatataacaataaacaaagcatacaaaaatctctgcccttgtgaagcttacctgtgagcagtggggggagacagataaagaaatatgtaaaactctgcacatgatatcaaattttggtaacttcagtggaaacatactaagcaggaaatggagataggaaagttgaatggggttggaaatgttgcactgtttaacgtggtgactaaagaaggctccaccaagaaggtgctatttaagcatctaaagaggtaaaggagttagccttgtggatatttgggagaatatagtttttaggtagtagaaacaaatgcaaaggccctagagtaagagtgtgcctggggagttagagataagcaaggaggccagggtgatgactacaaagataagagagcagtaggaaatagggcctggggggtaatggaggatagtacagagatcaggatgttcttcctctctccactaccaactaaatagtcattgcaagatgccatgttcctagtttctacatagggtacattttgagctcctaagagacaagtttattatatcaaatagaaaaaaaaatatatatatatatataactttatttcacaaaaatgaaatgctatgctcattaaacattaaaattcaagtaattttagtgtccttcatctgtctgccttataatcaggaaactagaaacaatgtgggtatctagattataataaataaatatttatttttagataagttatacttctcatgttaaaaaatactttctattttaccatatcactctatatatgacacttgatttatcacaatttgtcttggcaaaataactatcaaactattttatttaaacaaaaagttgattccctagttcccttcagtcttgtctagattttcaggatacagttagtttctcatttggtgctaccttatgagagaatttgatagaaaatggcctactcaataaaaagtcaaactttcttttttttttttttgagacagagtctcactctgtcgcccaggctggagtacagtggtgtgatcccagctcactgcaagctctgccccctgggttcatgccattctcctgactcagcctctcgagtagctgggactacaggtgcccgccaccacacccggctaattttttgtatttttagtagagatggggtttcaccgccaggatggtctcaatctcctgacctcgtgatccatcctcctgacctcgtgatccatccgcctcagcctcccaaagtgctgggattacagacatgagccaccgctcccggcctcaaactttcttttctaaaaactcattcaatcagagaatattagacagatagacatagagtattagacagatagaatattagacagaacttcctcataggaagacactctctgttgaac

SEQ ID NO: 185 - DNA, 8105 bp, Homo sapiens
tggttaattgggaaaagtaaccatctaatccagtttatttttttctaattttaatttttgtttttctttcaatagttttagagaaacaggtggggtttactgcatggaaaagtaatttagtggtgatttccaagattttggtgtacccattacctaagcagtgtacttgggtacactgtacccaatgtgtagtcttttttccttcaccctctgccctcttgatgcctctccatccttgtagcttggttcccacttataaatgataacatacaatgtttggttttccattcctgagttacttcacttagaataatggtctccaaccccatccaggttactgtgaatgccattatctcattccttttatggctgagtagtattccatggtgtgtgtgtgtgtgtgtgtgtgtgtgtgtgtgtgtgtgtgtatcacattttctttatccactcgttggttgatgggcatttaggctggttcacagttttgcagttataaattgtgctgctatagacatgcatgtgcaagtgtctttttcatataatgacatcttttcctctaggaagataaccagtagtgggattgctggatcaaatgatagttctacttttagttctttaagaaatcttcatactgttttccataatgattgtactagtctacatccccaccagcagtgtaaaactgttcccttttcaccacatccatgtcaacatctggtactttttaaatatggccattcttgcagtagtaaggtggtatctcattgtggttttgatttgcatttccctgatcattactgatgtagagcattttctcatatgtttgttggtcttttccatatcttcttttgagaattatctattcatatccttagcccaccttttgatgggattacttgttttcttcttgctgatttgttttcattccctgtagattttggatattagtcctttgtcgaatgtatagactgcaaagattttctcccactctgtgggttgtctgtttactctgctgattatttcttttgctatgcagaagctttttagtttaattaagttccatctatttatctttgtttttgttgcatttgcttttgggttcttggtcatgaggtctttgcctaagccaatgtctagaagtgtttttccaatgttatctcctagaatttttatggtttcaggtcttagattgaagtctttgatccatcttgagtggatttttatatacgatgagagatgaggatccagtttcattcttctacatgtggcttgccgattatcccagaaccatttgttgaatagggtgtcctttccccaccttatgttgttgttcgctttgtcaaagatcagttgactttaagtatttggctttatttctgggttctctgttctgctcctttggtctatatgagccctacctaactttttaattccaatttggatgccctttcttttttcacttgtctgattgctctaagtaggacttccaaaactatgttgactagaagtggtggaaatgggcatccttgtcttgtttcaattctcaaggggagtgctttcaacttttccccattcagtataatgtttgctgttgatttgtcatacacagtttttattaccttaaggtatgtcccttctgtgctaattttgctgagagttttaatcataaatgagtgctggattttgtcagatgctttttctccatctattgagatgatcatgtgatttttgtttttaattctgtttatgtgatatatcacagttttttttttttttctaagatggagtctcactctgtcacccaggctggagtgcagtggcatgatcttggctcactgcaacctctgcctcccaggttcaagctattctcctgcctcagcctctggagtagctgggactacagatgtgcaccacaatgcccggctaatttttttgtatatgttttttgtagtgacagggttttgccatgttggccaggctgatcttgaactcctgacctcatgatccaccctctcagcctctcaaagtgctgggattacaggcgtgagcctccacacccaacctgtatcacatttattgacttgcagatgttaaaccatccctgcatcctggtatgaaaaccacttgattatggtgtatgatccatttgatatgctcttagatattgttagctagtattttgtggaggatttttgcatctatgttcatcagggatattggtctgtagttttctttttttgttatgtcctttctgggttttggtaaatcccagaatgatttagggaggattccgtctttctctatcttttggaatactgtcaataggactggtaccaattctttgaatgtctgatagaattcagctgtgaggccatctggtcctggacttttttttgttggtaactttttaattactctttcaatttcgctgcttgttattggtctgttcagagtttctatttattcctgatttaatctagaagggttgtatatttcttggaatttatccatctcctctacattttctagtttgtccacataatggtgttcagaacagtcttgaatgatcttttgtatttccgtggtatcagttgtaatagctcccatttcgtttctaattgagctcatttggatcttctctcttcctttcttggttagtctcacagtctatcaattttgtttatctttcaaataaccaggttttgtttcatttctcttttgtatttttttgttttgatttcatttggttctgctctgatctttgttacttattttttctgttaggtttgggttggtttttctttgtttctctagttccttcaggtgtgactttagattgcctatttatgctctttcagactttttgatgtaagcatttaatgctatgaactttcctcatagcactgcttttgctgtgtcccagaggttttgacaagctgtgtcactactattgttcagttcaaagaattttttaatttccatcttgatttcattgttgacctaaagatcattcaggggcagattattgaatttccaagtatttgtatagttttgagggttccttttggagttaatttccaattttatttcactgtggtctgagagggtacttgatattattttgattttcttaaattaatattgagacttgttttgtggcctatcctatggtctatcttggagaatgttccatgtgctgatgagtagaatgtatattctgcggttttggggtagaatgttctgtaaatatttgttaagtccatttgttctgggtatagtttaaatccattgtttccttgttgactttctgtcttgatgacctctctagtgctgtcagtgaagcattgaagtcccccactattattgtgttgccatctatctcatttcttaggtctagtaataattattttataaatttgggagctccagtgttgggtgcatatatatttaggattatgatattttcttgttggatggatctttttatcattacataatgtctccctttgtctttttcaactgttgttgttttaaagtctgttttgtctgatataagaatagctactcctgctcacttttggtttccattttcatggggtatctttttccaccccattaccttaagtgagttcttatgcgttaagtgaatctcttgaagagagcagatacttggtgggtggatttttatccatgctgccattctgtattttttaagtgagcatttaggtcatttacattcaacataagtactgagatgtgaggtactgttttattcatcgtgctagctgttgcctgaacatcttgggttttttctttttgttagtgtttaataggccctgtgagatttacactttaacgaggttctattttggtgtatttcgaggttttgtttcaggatttagatctcgttttagcatttcttgtggtgctgacttggtagtgatgaattcactcaacatttgtttgtctgaaagatgaccttatctctccttcatttatgaagctcagttttgctggatacaaaattcttggctgaaatatactgtgtttgaggaggctaaggatagaccccaattcacttctggcttatagggtttctgctgagaaatctgctgttaatctgataggttttcctttataggttacctgatgctttcgcctcacagctcttgagattctttcctttgttcttgactttatataacctgatgacaactatgtgactgggtaatgatctttttgtgatgaatttaccaggtgttttttgagcttcttgtatttggatgtttagttctctggtgaggccaggcaaggtttcctcaattatgtttcccaaacttttagatttatcttcttcctcaggaacaccaattattcttgggtttggttaacataatcacaaatttcttggaggctttgttcatttttttttctttgtcttttttggattaggttacttcgaaagccttgtcttcaagctctgacattctttttcctactcattcaacatcattgttgaaactttctggtgcattttgtatttctctaagcgtgtctttcacttccagaagttgtgattgttttttctttacaatatctatttctctgtagcatttttcatccatatcctgtattgttttttaaatttgtttaaattggttttcccctttctctggtatctccttgagtaacttaattatcaaccttctaaattctttatctggcaattcagagatttttttttattggtttgaatcaattgctatgaagctagtgtggtctcttaggggtgttgtaaaacctcatcttgtcatattttctgattccttctcatttgggtagactatttcagtggaaaaatctggaactcaagggctgctatttagattcttttgtcccatggggtggtcccttgatgtggtacactgccccttcccctagggatgaggcttgctgcaagccagactgcagtgactggtattgctcttctgagtctagccaccgagtacggctaccaggctccgagctggtgctggggaatgtctacaaacagtcctgtgatgcgatccaccttcaggtctcccagccatggataccagcgcctgccctgttggaggtggcaggggcgtgaaatagactctgtgagagtccttggttgtagatatgtttagtgtgctggctttctcaaatgctggttatgctagcagtgacactgtcacgtggacagatttaggaccactggttagccaggatgttgcagggcacacggaattagctgttgttttcctcttccttggagcagcgttattctgtcattgagttgctgcaacgtcctgagttggtcagactacaggcagaaggtggtgctttcaagagagcaccagctgtgatagaagaggggggatataagcttgccctaagttgaccaagataagtgttcaggtttctcaagtaatgggcggggtcataaagctcccaaaagtttatgtctttcatgatccactactgggtatagagaaatactgtcaagtcagggcagggttaggcagatctgagctcagactccccttgggtggggcttgctgcagccactgtgggggtgtgggaggggtggttctcgggttaaattccaaaggggattatggctgcctctgttgccaggaaagtgagggaaagccagtagcgataggccccacccagcttttacccagttggtgaggcctgtctcactcccactgtgccatctaaaaccactgagtttgtctccaggcagcctgcacatgggactcagacctagccccaagttataagtttcccagctgagaaagcaagcagggctttcaggttacacccctccccatctgcccacattgtcccccatgactcctcctctcctttctgccgcagttcctgcttgcccccacattctgctcaagagagtttgtgcccagtcaaaattattgtaaaaatcacaattacttttgcgtagtatctaaacattttttaatatagtataataatatgaatttgatcagctcaagaaacttctaatgattttaactgtttaatccaaataaccatttacttcaaaggactcatcacaattatacttatttaatatcttacttgtttaatgtagtagacaatgagctccatgaaaacaaggtgtacatctctctcatcactaaaaccccagagcctaatgtggtgtctctttgatagtgggagatcaaatgtattttttcaaatgaaagaaatttaatgaagaactgttcattccatgccagatttggctgaattagaactggtccctgcattcaagaagctcacagtctgctgagggagagcaacatgtaatcaataaacaatagtacaatataataagtgctgtgccagaaatataaacaaataccatagaaacataagggaagaagtgattaattctgcttaaaggtagaaaatattaagaagtttttgaccaagtaataaatactcatttccttgggatggatgtttatactaagaaataatgtctatatcacattctattaacttgattagttccacagttcagtaaaacatattctatattgaaaaatttttttagatattactacgctatttcaggacatcttgaaagggcttattcctaaaataatcttttagaattttttttatattctctctctctctctctctatatatatatatataaattccctgaaagtagttcaacaacaaaaagtaaaattcaaggctataatattaataatactagtttgcttgctataggaaaacctagatgagaaagcctattgcttttttgccagctaccacatattagttacagtgatcatcaccaaattttcacttattatgtacttaacagaaatcaccagatcctttcacactcccaacaatagctttggggtttcactatctcactatatagggaaatctcatatgcactcaaaataaaagatttttttcctatattagctacagcacaaataatagcatccttcatttagaaacaaccagcctcatactcatctaaagcacataaatttagttaaatggtgccatctggtgacataaatcttgcagtaaatataaaagtcctgagtcagagtccagaatgatacccaaccctcttgatggcatccaatccaaagtgtctaatttaacttaagaaatacttgatcctgcctgacatgaaacacacaactaatcacactcagtatatggccgtttaacaaagggaattataacaattgtttgagccacattttatgctcaccactcttgtttctcaactctttggaagagacttgtatctaacaggatgccctatacaactcctagaagacattttaaaagcataaatatcaaggacattttgaatccctgttccaggcagatccatttcctcactctcctttgaacgtacatcaatgtgtataattttcaacacttcaaaatgtcacttccttaagaaagctgtcgaccaggtgtggtggctcacgcctgtaatcccagcgctttgggaggccaaggcaggcaaatcacaagctcaggagttcaagaccagcctggtcaacatggtgaaaccccgtctctactaaaaaaaaatacaaaaattagctgggcgtggtggcacatgcctgtagtcccagttactcaggaggctgaggcagaagaatcccttgaatgggaggtggaggttgcagtgagccaaagatcaagccactgcactccagcctgggtgacagagctagacttcatctcaaaaaaagaaggagaaagctgtccctgtttctactgttaaggttaagcctctcattcatagccaactctacttcttctttgtatataaactcttgacgaaattttgtttaatgcttgtctccccagtgtgtatcatagcgtttggcaaagtgttcaataaatatcctgtgaacgaattaatgtgtaaatggatggtgaaaacatccttctctactctctcttctaatgcaaatcctattaataacaaggctcagctcaagtttacattttatataaaaccttctctagcaacaacaatgtacaataagcccatgctt

SEQ ID NO: 186 - DNA, 1667 bp, Homo sapiens
agaccagttctctaggggcgtcgacgtgtgaaactgattttaaagaaaacaggcagtggcctttctctcggccccacgtggcccagtagcgctcaccttccgtcccttcttccgcgctcagtaaccaatttaggccgctcctgcagaactcgggctcctgcccaccggcccacagcgtccacctgaggcctcgtcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctcgccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgtacggatttccacgcgcggttcacgtgggccccagggggttgcccggcacccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagcggcgcccgcgcggcgctttctgcgggggtcgctttccgcccggggtgactccgctttcctgggcgatgccccccacccccaggcacgcgctctccccgtgcggccgcaccgcgcatgccggt
